(12) United States Patent
Edwards et al.

(10) Patent No.: US 7,393,663 B2
(45) Date of Patent: Jul. 1, 2008

(54) EXPRESSED SEQUENCE TAGS AND ENCODED HUMAN PROTEINS

(75) Inventors: Jean-Baptiste Dumas Milne Edwards, Paris (FR); Aymeric Duclert, Saint-Maur (FR); Bruno Lacroix, Saint-Genis Laval (FR)

(73) Assignee: Serono Genetics Institute S.A., Evry (FR)

( * ) Notice: Subject to any disclaimer, the term of this patent is extended or adjusted under 35 U.S.C. 154(b) by 973 days.

(21) Appl. No.: 10/631,441

(22) Filed: Jul. 30, 2003

(65) Prior Publication Data

US 2007/0027308 A1 Feb. 1, 2007

Related U.S. Application Data

(60) Division of application No. 09/547,599, filed on Apr. 11, 2000, now abandoned, which is a continuation-in-part of application No. 08/905,223, filed on Aug. 1, 1997, now Pat. No. 6,222,029, and a continuation-in-part of application No. 08/905,135, filed on Aug. 1, 1997, now abandoned, and a continuation-in-part of application No. 08/905,051, filed on Aug. 1, 1997, now abandoned, and a continuation-in-part of application No. 08/905,144, filed on Aug. 1, 1997, now abandoned, and a continuation-in-part of application No. 08/905,279, filed on Aug. 1, 1997, now abandoned, and a continuation-in-part of application No. 08/904,468, filed on Aug. 1, 1997, now abandoned, and a continuation-in-part of application No. 08/905,134, filed on Aug. 1, 1997, now abandoned, and a continuation-in-part of application No. 08/905,133, filed on Aug. 1, 1997, now abandoned.

(51) Int. Cl.
| | |
|---|---|
| C12P 21/02 | (2006.01) |
| C12P 19/34 | (2006.01) |
| C12N 15/00 | (2006.01) |
| C12N 15/11 | (2006.01) |
| C12N 15/12 | (2006.01) |

(52) U.S. Cl. .................. 435/69.8; 435/69.1; 435/69.7; 435/91.1; 435/320.1; 536/23.5

(58) Field of Classification Search .................. None
See application file for complete search history.

(56) References Cited

U.S. PATENT DOCUMENTS

| | | | |
|---|---|---|---|
| 5,605,817 A | 2/1997 | Coleman et al. | |
| 5,700,637 A | 12/1997 | Southern et al. | |
| 5,776,731 A | 7/1998 | Parnet et al. | |
| 5,932,549 A | 8/1999 | Allen et al. | |
| 5,985,863 A | 11/1999 | Su et al. | |
| 6,605,280 B1 | 8/2003 | Novick et al. | |

FOREIGN PATENT DOCUMENTS

| | | |
|---|---|---|
| EP | 0 625 572 A1 | 11/1994 |
| EP | 0 850 952 A1 | 7/1998 |
| EP | 0 864 585 A1 | 9/1998 |
| WO | WO 96/34981 A2 | 11/1996 |

OTHER PUBLICATIONS

Adams et al, Nature Genet. 4: 373 (1993).*
Schena, M. et al. "Quantitative Monitoring of Gene Expression Patterns with a Complementary DNA Microarray" *Science*, Oct. 20, 1995, pp. 467-470, vol. 270.
Adams et al. "Initial Assessment of Human Gene Diversity and Expression Patterns Based upon 83 Million Nucleotides of cDNA Sequence" *Nature*, 1995, vol. 377, pp. 3-17.
Carninci et al. "High-Efficiency Full-Length cDNA Cloning by Biotinylated CAP Trapper" *Genomics*, 1996, pp. 327-336, vol. 37.
Hillier et al. "Generation and Analysis of 280,000 Human Expressed Sequence Tags" *Genome Research*, 1996, pp. 807-828, vol. 6.
Kato et al. "Construction of a Human Full-Length cDNA Bank" *Gene*, 1994, pp. 243-250, vol. 150.
von Heijne et al. "A New Method for Predicting Signal Sequence Cleavage Sites" *Nucleic Acids Research*, 1986, pp. 4683-4690, vol. 14, No. 11.
Aizawa, Y., et al., "Cloning and expression of interleukin-18 binding protein", *FEBS Lett.* (1999), 445(2-3):338-342.
Car, B.D., et al., "Interferon γ Receptor Deficient Mice Are Resistant to Endotoxic Shock", *J. Exp. Med.* (1994), 179(5):1437-44.
Dao, T. et al., "Interferon-γ-inducing Factor, a Novel Cytokine, Enhances Fas Ligand-Mediated Cytotoxicity of Murine T Helper 1 Cells", *Cell Immunol.* (1996), 173(2):230-5.
Engelmann, H., et al., "A Tumor Necrosis Factor-binding Protein Purified to Homogeneity from Human Urine Protects Cells from Tumor Necrosis Factor Toxicity" *J. Biol. Chem.* (1989), 264(20):11974-80.
Engelmann, H., et al., "Two Tumor Necrosis Factor-binding Proteins Purified from Human Urine" *J. Biol. Chem.* (1989), 264(20):1531-6.
Ghayur, T., et al., "Caspase-1 processes IFN-γ-inducing factor and regulates LPS-induced IFN-γ production", *Nature* (1997), 386(6625):619-23.

(Continued)

*Primary Examiner*—James Martinell
(74) *Attorney, Agent, or Firm*—Saliwanchik, Lloyd & Saliwanchik

(57) ABSTRACT

The sequences of 5' ESTs derived from mRNAs encoding secreted proteins are disclosed. The 5' ESTs may be to obtain cDNAs and genomic DNAs corresponding to the 5' ESTs. The 5' ESTs may also be used in diagnostic, forensic, gene therapy, and chromosome mapping procedures. Upstream regulatory sequences may also be obtained using the 5' ESTs. The 5' ESTs may also be used to design expression vectors and secretion vectors.

27 Claims, 11 Drawing Sheets

OTHER PUBLICATIONS

Gu, Y., et al., "Activation of Interferon-γ Inducing Factor Mediated by Interleukin-1β Converting Enzyme", *Science* (1997), 275:206-9.

Heremans, H., et al., "Interferon-γ, A Mediator of Lethal Lipopolysaccharide-Induced Shwartzman-like Shock Reactions in Mice", *J. Exp. Med.* (1990), 171(6):1853-1869.

Kohno, K., et al., "IFN-γ-inducing Factor (IGIF) is a Costimulatory Factor on the Activation of TH1 but not Th2 Cells and Exerts its Effect Independently of IL-12", *J. Immunol.* (1997), 158(4):1541-50.

Maliszewski, C.R., et al., "Cytokine Receptors and B Cell Functions", *J. Immunol.* (1990), 144(8):3028-33.

Micallef, M.J., et al., "Interferon- γ-inducing factor enhances T helper 1 cytokine production by stimulated human T cells: synergism with interleukin-12 for interferon-γ production", *Eur. J. Immunol.* (1996), 26(7):1647-1651.

Nakamura, K., et al., "Endotoxin-Induced Serum Factor that Stiulates Gamma Interferon Production", *Infection and Immunity* (1989), 57(2):590-595.

Nakamura, K., et al., "Purification of a Factor Which Provides a Costimulatory Signal for Gamma Interferon Production", *Infection and Immunity* (1993), 61(1):64-70.

Novick, D., et al., "Soluble Cytokine Receptors are Present in Normal Human Urine", *J. Exp. Med.* (1989), 170(4):1409-1414.

Novick, D., et al., "Soluble interferon-α receptor molecules are present in body fluids", *FEBS Lett.* (1992), 314(3):445-8.

Novick, D., et al., "The human interferon alpha/beta receptor: characterization and molecular cloning", *Cell* (1994), 77(3):391-400.

Novick, et al., "Interleukin-18 binding protein: a novel modulator of the Th1 cytokine resonse", *Immunity* 1999), 10(1):127-136.

Okamura, et al., "Cloning of a new cytokine that induces IFN-gamma production by T cells", *Nature* (1995), 378(6552):88-91.

Parnet, et al., "IL-1Rrp is a novel receptor-like molecule similar to the type I interleukin-1 receptor and its homologues T1/ST2 and IL-1R AcP", *J. Biol. Chem.* (1996), 271(8):3967-70.

Rothe, et al., "Active stage of autoimmune diabetes is associated with the expression of a novel cytokine, IGIF, which is located near Idd2", *J. Clin. Invest.* (1997), 99(3):469-74.

Sarvetnick, "IFN-gamma, IGIF, and IDDM", *J. Clin. Invest.* (1997), 99(3):371-2.

Simonet, W.S., et al., "Osteoprotegerin: A Novel Secreted Protein Involved in the Regulation of Bone Density", *Cell* (1997), 89(2):309-319.

Tsutsui, H., et al., "IFN-gamma-induced fctor up-regulates Fas ligand-mediated cytotoxic activity of murine natural killer cell clones", *J. Immunol.* (1996), 157(9):3967-73.

Ushio, et al., "Cloning of the cDNA for human IFN-gamma-inducing factor, expression in *Escherichia coli*, and studies on the biologic activities of the protein", *J. Immunol.* (1996), 156(11):4274-9.

Xiang and Moss, "Identification of human and mouse homologs of the MC51L-53L-54L family of secreted glycoproteins encoded by the *Molluscum contagiosum* poxvirus", *Virology* (1999), 257(2):297-302.

Database SWISSPROT, Accession No. O95998; Interleukin-18 binding protein, created May 2000.

* cited by examiner

| Minimum signal peptide score | false positive rate | false negative rate | proba(0.1) | proba(0.2) |
|---|---|---|---|---|
| 3,5 | 0,121 | 0,036 | 0,467 | 0,664 |
| 4 | 0,096 | 0,06 | 0,519 | 0,708 |
| 4,5 | 0,078 | 0,079 | 0,565 | 0,745 |
| 5 | 0,062 | 0,098 | 0,615 | 0,782 |
| 5,5 | 0,05 | 0,127 | 0,659 | 0,813 |
| 6 | 0,04 | 0,163 | 0,694 | 0,836 |
| 6,5 | 0,033 | 0,202 | 0,725 | 0,855 |
| 7 | 0,025 | 0,248 | 0,763 | 0,878 |
| 7,5 | 0,021 | 0,304 | 0,78 | 0,889 |
| 8 | 0,015 | 0,368 | 0,816 | 0,909 |
| 8,5 | 0,012 | 0,418 | 0,836 | 0,92 |
| 9 | 0,009 | 0,512 | 0,856 | 0,93 |
| 9,5 | 0,007 | 0,581 | 0,863 | 0,934 |
| 10 | 0,006 | 0,679 | 0,835 | 0,919 |

FIG. 2

| Minimum signal peptide score | All ESTs | New ESTs | ESTs matching public EST closer than 40 bp from beginning | ESTs extending known mRNA more than 40 bp | ESTs extending public EST more than 40 bp |
|---|---|---|---|---|---|
| 3,5 | 2674 | 947 | 599 | 23 | 150 |
| 4 | 2278 | 784 | 498 | 23 | 126 |
| 4,5 | 1943 | 647 | 425 | 22 | 112 |
| 5 | 1657 | 523 | 353 | 21 | 96 |
| 5,5 | 1417 | 419 | 307 | 19 | 80 |
| 6 | 1180 | 340 | 238 | 18 | 68 |
| 6,5 | 1035 | 280 | 186 | 18 | 60 |
| 7 | 893 | 219 | 161 | 15 | 48 |
| 7,5 | 753 | 173 | 132 | 12 | 36 |
| 8 | 636 | 133 | 101 | 11 | 29 |
| 8,5 | 543 | 104 | 83 | 8 | 26 |
| 9 | 456 | 81 | 63 | 6 | 24 |
| 9,5 | 364 | 57 | 48 | 6 | 18 |
| 10 | 303 | 47 | 35 | 6 | 15 |

FIG. 4

| Tissue | All ESTs | New ESTs | ESTs matching public EST closer than 40 bp from beginning | ESTs extending known mRNA more than 40 bp | ESTs extending public EST more than 40 bp |
|---|---|---|---|---|---|
| Brain | 329 | 131 | 75 | 3 | 24 |
| Cancerous prostate | 134 | 40 | 37 | 1 | 6 |
| Cerebellum | 17 | 9 | 1 | 0 | 6 |
| Colon | 21 | 11 | 4 | 0 | 0 |
| Dystrophic muscle | 41 | 18 | 8 | 0 | 1 |
| Fetal brain | 70 | 37 | 16 | 0 | 1 |
| Fetal kidney | 227 | 116 | 46 | 1 | 19 |
| Fetal liver | 13 | 7 | 2 | 0 | 0 |
| Heart | 30 | 15 | 7 | 0 | 1 |
| Hypertrophic prostate | 86 | 23 | 22 | 2 | 2 |
| Kidney | 10 | 7 | 3 | 0 | 0 |
| Large intestine | 21 | 8 | 4 | 0 | 1 |
| Liver | 23 | 9 | 6 | 0 | 0 |
| Lung | 24 | 12 | 4 | 0 | 1 |
| Lung (cells) | 57 | 38 | 6 | 0 | 4 |
| Lymph ganglia | 163 | 60 | 23 | 2 | 12 |
| Lymphocytes | 23 | 6 | 4 | 0 | 2 |
| Muscle | 33 | 16 | 6 | 0 | 4 |
| Normal prostate | 131 | 61 | 45 | 7 | 11 |
| Ovary | 90 | 57 | 12 | 1 | 2 |
| Pancreas | 48 | 11 | 6 | 0 | 1 |
| Placenta | 24 | 5 | 1 | 0 | 0 |
| Prostate | 34 | 16 | 4 | 0 | 2 |
| Spleen | 56 | 28 | 10 | 0 | 1 |
| Substantia nigra | 108 | 47 | 27 | 1 | 6 |
| Surrenals | 15 | 3 | 3 | 1 | 0 |
| Testis | 131 | 68 | 25 | 1 | 8 |
| Thyroid | 17 | 8 | 2 | 0 | 2 |
| Umbilical cord | 55 | 17 | 12 | 1 | 3 |
| Uterus | 28 | 15 | 3 | 0 | 2 |
| Non tissue-specific | 568 | 48 | 177 | 2 | 28 |
| Total | 2677 | 947 | 601 | 23 | 150 |

FIG. 5

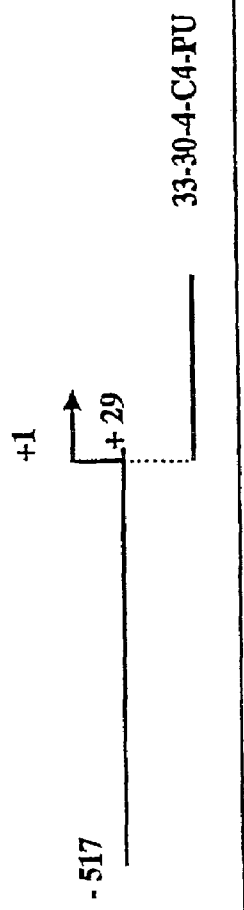
FIG. 6A  Promoter P13H2
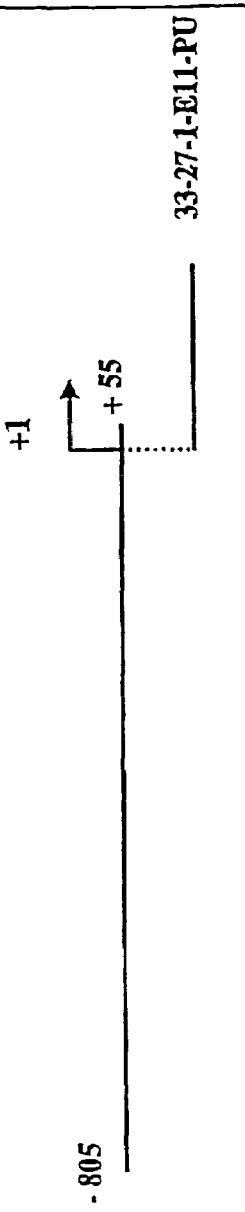
FIG. 6B  Promoter P15B4
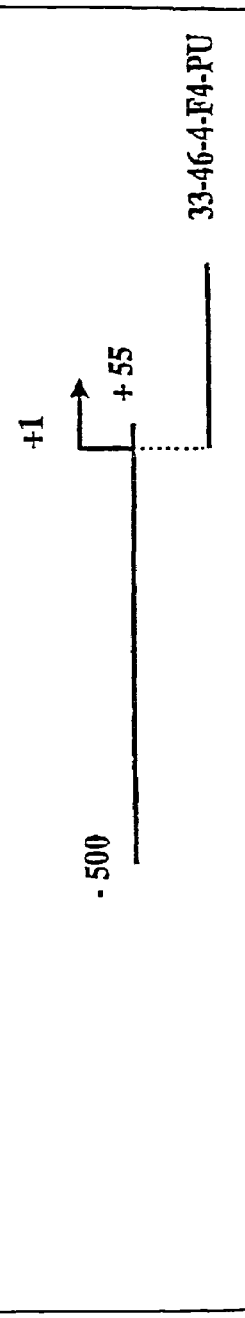
FIG. 6C  Promoter P29B6

Description of Transcription Factor Binding Sites present on promoters isolated from 5' EST sequences Promoter sequence P13H2 (546 bp):

| Matrix | Position | Orientation | Score | Length | Sequence | Location in: SEQ ID NO: 31 |
|---|---|---|---|---|---|---|
| CMYB_01 | -502 | + | 0.983 | 9 | TGTCAGTTG | 17-25 |
| MYOD_Q6 | -501 | - | 0.961 | 10 | CCCAACTGAC | complement of 18-27 |
| S8_01 | -444 | - | 0.960 | 11 | AATAGAATTAG | complement of 75-85 |
| S8_01 | -425 | + | 0.966 | 11 | AACTAAATTAG | 94-104 |
| DELTAEF1_01 | -390 | - | 0.960 | 11 | GCACACCTCAG | complement of 129-139 |
| GATA_C | -364 | - | 0.964 | 11 | AGATAAATCCA | complement of 155-165 |
| CMYB_01 | -349 | + | 0.958 | 9 | CTTCAGTTG | 170-178 |
| GATA1_02 | -343 | + | 0.959 | 14 | TTGTAGATAGGACA | 176-189 |
| GATA_C | -339 | + | 0.953 | 11 | AGATAGGACAT | 180-190 |
| TAL1ALPHAE47_01 | -235 | + | 0.973 | 16 | CATAACAGATGGTAAG | 284-299 |
| TAL1BETAE47_01 | -235 | + | 0.983 | 16 | CATAACAGATGGTAAG | 284-299 |
| TAL1BETAITF2_01 | -235 | + | 0.978 | 16 | CATAACAGATGGTAAG | 284-299 |
| MYOD_Q6 | -232 | - | 0.954 | 10 | ACCATCTGTT | complement of 287-296 |
| GATA1_04 | -217 | - | 0.953 | 13 | TCAAGATAAAGTA | complement of 302-314 |
| IK1_01 | -126 | + | 0.963 | 13 | AGTTGGGAATTCC | 393-405 |
| IK2_01 | -126 | + | 0.985 | 12 | AGTTGGGAATTC | 393-404 |
| CREL_01 | -123 | + | 0.962 | 10 | TGGGAATTCC | 396-405 |
| GATA1_02 | -96 | + | 0.950 | 14 | TCAGTGATATGGCA | 423-436 |
| SRY_02 | -41 | - | 0.951 | 12 | TAAAACAAAACA | complement of 478-489 |
| E2F_02 | -33 | + | 0.957 | 8 | TTTAGCGC | 486-493 |
| MZF1_01 | -5 | - | 0.975 | 8 | TGAGGGA | complement of 514-521 |

Promoter sequence P15B4 (861 bp):

| Matrix | Position | Orientation | Score | Length | Sequence | Location in: SEQ ID NO: 34 |
|---|---|---|---|---|---|---|
| NFY_Q6 | -748 | - | 0.956 | 11 | GGACCAATCAT | complement of 60-70 |
| MZF1_01 | -738 | + | 0.962 | 8 | CCTGGGGA | 70-77 |
| CMYB_01 | -684 | + | 0.994 | 9 | TGACCGTTG | 124-132 |
| VMYB_02 | -682 | - | 0.985 | 9 | TCCAACGGT | complement of 126-134 |
| STAT_01 | -673 | + | 0.968 | 9 | TTCCTGGAA | 135-143 |
| STAT_01 | -673 | - | 0.951 | 9 | TTCCAGGAA | complement of 135-143 |
| MZF1_01 | -556 | - | 0.956 | 8 | TTGGGGGA | complement of 252-259 |
| IK2_01 | -451 | + | 0.965 | 12 | GAATGGGATTTC | 357-368 |
| MZF1_01 | -424 | + | 0.986 | 8 | AGAGGGGA | 384-391 |
| SRY_02 | -398 | - | 0.955 | 12 | GAAAACAAAACA | complement of 410-421 |
| MZF1_01 | -216 | + | 0.960 | 8 | GAAGGGGA | 592-599 |
| MYOD_Q6 | -190 | + | 0.981 | 10 | AGCATCTGCC | 618-627 |
| DELTAEF1_01 | -176 | + | 0.958 | 11 | TCCCACCTTCC | 632-642 |
| S8_01 | 5 | - | 0.992 | 11 | GAGGCAATTAT | complement of 813-823 |
| MZF1_01 | 16 | - | 0.986 | 8 | AGAGGGGA | complement of 824-831 |

Promoter sequence P29B6 (555 bp):

| Matrix | Position | Orientation | Score | Length | Sequence | Location in: SEQ ID NO: 37 |
|---|---|---|---|---|---|---|
| ARNT_01 | -311 | + | 0.964 | 16 | GGACTCACGTGCTGCT | 191-206 |
| NMYC_01 | -309 | + | 0.965 | 12 | ACTCACGTGCTG | 193-204 |
| USF_01 | -309 | + | 0.985 | 12 | ACTCACGTGCTG | 193-204 |
| USF_01 | -309 | - | 0.985 | 12 | CAGCACGTGAGT | complement of 193-204 |
| NMYC_01 | -309 | - | 0.956 | 12 | CAGCACGTGAGT | complement of 193-204 |
| MYCMAX_02 | -309 | - | 0.972 | 12 | CAGCACGTGAGT | complement of 193-204 |
| USF_C | -307 | + | 0.997 | 8 | TCACGTGC | 195-202 |
| USF_C | -307 | - | 0.991 | 8 | GCACGTGA | complement of 195-202 |
| MZF1_01 | -292 | - | 0.968 | 8 | CATGGGGA | complement of 210-217 |
| ELK1_02 | -105 | + | 0.963 | 14 | CTCTCCGGAAGCCT | 397-410 |
| CETS1P54_01 | -102 | + | 0.974 | 10 | TCCGGAAGCC | 400-409 |
| AP1_Q4 | -42 | - | 0.963 | 11 | AGTGACTGAAC | complement of 460-470 |
| AP1FJ_Q2 | -42 | - | 0.961 | 11 | AGTGACTGAAC | complement of 460-470 |
| PADS_C | 45 | + | 1.000 | 9 | TGTGGTCTC | 547-555 |

FIG. 7

EXPRESSED SEQUENCE TAGS AND ENCODED HUMAN PROTEINS

RELATED APPLICATIONS

This application is divisional of U.S. patent application Ser. No. 09/547,599, filed Apr. 11, 2000 now anandoned, which is a continuation-in-part of U.S. patent applications Ser. No. 08/905,223, filed Aug. 1, 1997 now U.S. Pat. No. 6,222,029, Ser. No. 08/905,135, filed Aug. 1, 1997 now abandoned, Ser. No. 08/905,051, filed Aug. 1, 1997 now abandoned, Ser. No. 08/905,144, filed Aug. 1, 1997 now abandoned, Ser. No. 08/905,279, filed Aug. 1, 1997 now abandoned, Ser. No. 08/904,468, Aug. 1, 1997 now abandoned, Ser. No. 08/905,134, filed Aug. 1, 1997 now abandoned, Ser. No. 08/905,133, filed Aug. 1, 1997 now abandoned, the disclosures of which are incorporated herein by reference in their entireties.

BACKGROUND OF THE INVENTION

The estimated 50,000-100,000 genes scattered along the human chromosomes offer tremendous promise for the understanding, diagnosis, and treatment of human diseases. In addition, probes capable of specifically hybridizing to loci distributed throughout the human genome find applications in the construction of high resolution chromosome maps and in the identification of individuals.

In the past, the characterization of even a single human gene was a painstaking process, requiring years of effort. Recent developments in the areas of cloning vectors, DNA sequencing, and computer technology have merged to greatly accelerate the rate at which human genes can be isolated, sequenced, mapped, and characterized. Cloning vectors such as yeast artificial chromosomes (YACs) and bacterial artificial chromosomes (BACs) are able to accept DNA inserts ranging from 300 to 1000 kilobases (kb) or 100-400 kb in length respectively, thereby facilitating the manipulation and ordering of DNA sequences distributed over great distances on the human chromosomes. Automated DNA sequencing machines permit the rapid sequencing of human genes. Bio-informatics software enables the comparison of nucleic acid and protein sequences, thereby assisting in the characterization of human gene products.

Currently, two different approaches are being pursued for identifying and characterizing the genes distributed along the human genome. In one approach, large fragments of genomic DNA are isolated, cloned, and sequenced. Potential open reading frames in these genomic sequences are identified using bio-informatics software. However, this approach entails sequencing large stretches of human DNA which do not encode proteins in order to find the protein encoding sequences scattered throughout the genome. In addition to requiring extensive sequencing, the bio-informatics software may mischaracterize the genomic sequences obtained. Thus, the software may produce false positives in which non-coding DNA is mischaracterized as coding DNA or false negatives in which coding DNA is mislabeled as non-coding DNA.

An alternative approach takes a more direct route to identifying and characterizing human genes. In this approach, complementary DNAs (cDNAs) are synthesized from isolated messenger RNAs (mRNAs) which encode human proteins. Using this approach, sequencing is only performed on DNA which is derived from protein coding portions of the genome. Often, only short stretches of the cDNAs are sequenced to obtain sequences called expressed sequence tags (ESTs). The ESTs may then be used to isolate or purify extended cDNAs which include sequences adjacent to the EST sequences. The extended cDNAs may contain all of the sequence of the EST which was used to obtain them or only a portion of the sequence of the EST which was used to obtain them. In addition, the extended cDNAs may contain the full coding sequence of the gene from which the EST was derived or, alternatively, the extended cDNAs may include portions of the coding sequence of the gene from which the EST was derived. It will be appreciated that there may be several extended cDNAs which include the EST sequence as a result of alternate splicing or the activity of alternative promoters.

In the past, these short EST sequences were often obtained from oligo-dT primed cDNA libraries. Accordingly, they mainly corresponded to the 3' untranslated region of the mRNA. In part, the prevalence of EST sequences derived from the 3' end of the mRNA is a result of the fact that typical techniques for obtaining cDNAs, are not well suited for isolating cDNA sequences derived from the 5' ends of mRNAs. (Adams et al., *Nature* 377:174, 1996, Hillier et al., *Genome Res.* 6:807-828, 1996).

In addition, in those reported instances where longer cDNA sequences have been obtained, the reported sequences typically correspond to coding sequences and do not include the full 5' untranslated region of the mRNA from which the cDNA is derived. Such incomplete sequences may not include the first exon of the mRNA, particularly in situations where the first exon is short. Furthermore, they may not include some exons, often short ones, which are located upstream of splicing sites. Thus, there is a need to obtain sequences derived from the 5' ends of mRNAs.

While many sequences derived from human chromosomes have practical applications, approaches based on the identification and characterization of those chromosomal sequences which encode a protein product are particularly relevant to diagnostic and therapeutic uses. Of the 50,000-100,000 protein coding genes, those genes encoding proteins which are secreted from the cell in which they are synthesized, as well as the secreted proteins themselves, are particularly valuable as potential therapeutic agents. Such proteins are often involved in cell to cell communication and may be responsible for producing a clinically relevant response in their target cells.

In fact, several secretory proteins, including tissue plasminogen activator, G-CSF, GM-CSF, erythropoietin, human growth hormone, insulin, interferon-α, interferon-β, interferon-γ, and interleukin-2, are currently in clinical use. These proteins are used to treat a wide range of conditions, including acute myocardial infarction, acute ischemic stroke, anemia, diabetes, growth hormone deficiency, hepatitis, kidney carcinoma, chemotherapy induced neutropenia and multiple sclerosis. Thus, there is a need for the identification and characterization of secreted proteins and the nucleic acids encoding them.

In addition to being therapeutically useful themselves, secretory proteins include short peptides, called signal peptides, at their amino termini which direct their secretion. These signal peptides are encoded by the signal sequences located at the 5' ends of the coding sequences of genes encoding secreted proteins. Because these signal peptides will direct the extracellular secretion of any protein to which they are operably linked, the signal sequences may be exploited to direct the efficient secretion of any protein by operably lining the signal sequences to a gene encoding the protein for which secretion is desired. This may prove beneficial in gene therapy strategies in which it is desired to deliver a particular gene product to cells other than the cell in which it is produced. Signal sequences encoding signal peptides also find application in simplifying protein purification techniques. In such applications, the extracellular secretion of the desired protein greatly facilitates purification by reducing the number of undesired proteins from which the desired protein must be selected. Thus, there exists a need to identify and characterize the 5' portions of the genes for secretory proteins which encode signal peptides.

Public information on the number of human genes for which the promoters and upstream regulatory regions have been identified and characterized is quite limited. In part, this may be due to the difficulty of isolating such regulatory sequences. Upstream regulatory sequences such as transcription factor binding sites are typically too short to be utilized as probes for isolating promoters from human genomic libraries. Recently, some approaches have been developed to isolate human promoters. One of them consists of making a CpG island library (Cross, S. H. et al., Purification of CpG Islands using a Methylated DNA Binding Column, Nature Genetics 6: 236-244 (1994)). The second consists of isolating human genomic DNA sequences containing SpeI binding sites by the use of SpeI binding protein. (Mortlock et al., *Genome Res.* 6:327-335, 1996). Both of these approaches have their limits due to a lack of specificity or of comprehensiveness.

The present 5' ESTs may be used to efficiently identify and isolate upstream regulatory regions which control the location, developmental stage, rate, and quantity of protein synthesis, as well as the stability of the mRNA. (Theil, *BioFactors* 4:87-93, 1993). Once identified and characterized, these regulatory regions may be utilized in gene therapy or protein purification schemes to obtain the desired amount and locations of protein synthesis or to inhibit, reduce, or prevent the synthesis of undesirable gene products.

In addition, EST's containing the 5' ends of secretory protein genes may include sequences useful as probes for chromosome mapping and the identification of individuals. Thus, there is a need to identify and characterize the sequences upstream of the 5' coding sequences of genes encoding secretory proteins.

SUMMARY OF THE INVENTION

The present invention relates to purified, isolated, or recombinant ESTs which include sequences derived from the authentic 5' ends of their corresponding mRNAs. The term "corresponding mRNA" refers to the mRNA which was the template for the cDNA synthesis which produced the 5' EST. These sequences will be referred to hereinafter as "5' ESTs." As used herein, the term "purified" does not require absolute purity; rather, it is intended as a relative definition. Individual 5' EST clones isolated from a cDNA library have been conventionally purified to electrophoretic homogeneity. The sequences obtained from these clones could not be obtained directly either from the library or from total human DNA. The cDNA clones are not naturally occurring as such, but rather are obtained via manipulation of a partially purified naturally occurring substance (messenger RNA). The conversion of mRNA into a cDNA library involves the creation of a synthetic substance (cDNA) and pure individual cDNA clones can be isolated from the synthetic library by clonal selection. Thus, creating a cDNA library from messenger RNA and subsequently isolating individual clones from that library results in an approximately $10^4$-$10^6$ fold purification of the native message. Purification of starting material or natural material to at least one order of magnitude, preferably two or three orders, and more preferably four or five orders of magnitude is expressly contemplated. As an alternative embodiment, purification of the polynucleotides of the present invention may be expressed as "at least" a percent purity relative to heterologous polynucleotides (DNA, RNA or both). As a preferred embodiment, the polynucleotides of the present invention are at least; 10%, 20%, 30%, 40%, 50%, 60%, 70%, 80%, 90%, 95%, 96%, 96%, 98%, 99%, or 100% pure relative to heterologous polynucleotides. As a further preferred embodiment the polynucleotides have a purity ranging from any integer, to the thousandth position, between 90% and 100% (e.g., 5' EST at least 99.995% pure) relative to either heterologous polynucleotides or as a weight/weight ratio relative to all compounds and molecules other than those existing in the carrier.

As used herein, the term "isolated" requires that the material be removed from its original environment (e.g., the natural environment if it is naturally occurring). For example, a naturally-occurring polynucleotide present in a living animal is not isolated, but the same polynucleotide, separated from some or all of the coexisting materials in the natural system, is isolated. Specifically excluded from the definition of "isolated" are: artificial chromosome libraries, genomic libraries, and cDNA libraries that exist either as an in vitro nucleic acid preparation or as a transfected/transformed host cell preparation, wherein the host cells are either an in vitro heterogeneous preparation or plated as a heterogeneous population of single colonies, and further wherein the polynucleotide of the present invention makes up less than 5% (or alternatively 1%, 2%, 3%, 4%, 10%, 25%, 50%, 75%, or 90%, 95%, or 99%) of the number of nucleic acid inserts in the vector molecules. Further specifically excluded are whole cell genomic DNA or whole cell RNA preparations (including said whole cell preparations which are mechanically sheared or enzymaticly digested). Further specifically excluded are the above whole cell preparations as either an in vitro preparation or as a heterogeneous mixture separated by electrophoresis (including blot transfers of the same) wherein the polynucleotide of the invention have not been further separated from the heterologous polynucleotides in the electrophoresis medium (e.g., further separating by excising a single band from a heterogeneous band population in an agarose gel or nylon blot).

As used herein, the term "recombinant" means that the 5' EST is adjacent to "backbone" nucleic acid to which it is not adjacent in its natural environment. Additionally, to be "enriched" the 5' ESTs will represent 5% or more of the number of nucleic acid inserts in a population of nucleic acid backbone molecules. Backbone molecules according to the present invention include nucleic acids such as expression vectors, self-replicating nucleic acids, viruses, integrating nucleic acids, and other vectors or nucleic acids used to maintain or manipulate a nucleic acid insert of interest. Preferably, the enriched 5' ESTs represent 15% or more of the number of nucleic acid inserts in the population of recombinant backbone molecules. More preferably, the enriched 5' ESTs represent 50% or more of the number of nucleic acid inserts in the population of recombinant backbone molecules. In a highly preferred embodiment, the enriched 5' ESTs represent 90% or more (including any integer between 90 and 100%, to the thousandth position, e.g., 99.5%) of the number of nucleic acid inserts in the population of recombinant backbone molecules.

"Stringent", moderate," and "low" hybridization conditions are as defined in Example 29.

The term "polypeptide" refers to a polymer of amino acids without regard to the length of the polymer; thus, peptides, oligopeptides, and proteins are included within the definition of polypeptide. This term also does not specify or exclude chemical or post-expression modifications of the polypeptides of the invention, although chemical or post-expression modifications of these polypeptides may be included excluded as specific embodiments. Therefore, for example, modifications to polypeptides which include the covalent attachment of glycosyl groups, acetyl groups, phosphate groups, lipid groups and the like are expressly encompassed by the term polypeptide. Further, polyeptides with these modifications may be specified as individual species to be included or excluded from the present invention. The natural or other chemical modifications, such as those listed in example above, can occur anywhere in a polypeptide, including the peptide backbone, the amino acid side-chains and the amino or carboxyl termini. It will be appreciated that the same type of modification may be present in the same or varying degrees at several sites in a given polypeptide. Also, a given polypeptide may contain many types of modifications. Polypeptides may be branched, for example, as a result of ubiquitination, and they may be cyclic, with or without branching. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POSTTRANSLATIONAL COVALENT MODIFICATION OF PROTEINS, B. C. Johnson, Ed., Academic Press, New York, pgs. 1-12 (1983); Seifter et al., Meth Enzymol 182:626-646 (1990); Rattan et al., Ann NY Acad Sci 663:48-62 (1992).). Also included within the definition are polypeptides which contain one or more analogs of an amino acid (including, for example, non-naturally occurring amino acids, amino acids which only occur naturally in an unrelated biological system, modified amino acids from mammalian systems etc.), polypeptides with substituted linkages, as well as other modifications known in the art, both naturally occurring and non-naturally occurring.

As used interchangeably herein, the terms "nucleic acids", "oligonucleotides", and "polynucleotides" include RNA or DNA (either single or double stranded or antisense), or RNA/DNA hybrid sequences of more than one nucleotide in either single chain or duplex form (although each of the above species may be particularly specified). The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064. Preferred modifications of the present invention include, but are not limited to, 5-fluorouracil, 5-bromouracil, 5-chlorouracil, 5-iodouracil, hypoxanthine, xantine, 4-acetylcytosine, 5-(carboxyhydroxylmethyl)uracil, 5-carboxymethylaminomethyl-2-thiouridine, 5-carboxymethylarninomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v) ybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid, 5-methyl-2-thiouracil, 3-(3-amino-3-N-2-carboxypropyl) uracil, and 2,6-diaminopurine. Methylenemethylimino linked oligonucleosides as well as mixed backbone compounds having, may be prepared as described in U.S. Pat. Nos. 5,378,825; 5,386,023; 5,489,677; 5,602,240; and 5,610,289. Formacetal and thioformacetal linked oligonucleosides may be prepared as described in U.S. Pat. Nos. 5,264,562 and 5,264,564. Ethylene oxide linked oligonucleosides may be prepared as described in U.S. Pat. No. 5,223,618. Phosphinate oligonucleotides may be prepared as described in U.S. Pat. No. 5,508,270. Alkyl phosphonate oligonucleotides may be prepared as described in U.S. Pat. No. 4,469,863. 3'-Deoxy-3'-methylene phosphonate oligonucleotides may be prepared as described in U.S. Pat. No. 5,610,289 or U.S. Pat. No. 5,625,050. Phosphoramidite oligonucleotides may be prepared as described in U.S. Pat. No. 5,256,775 or U.S. Pat. No. 5,366,878. Alkylphosphonothioate oligonucleotides may be prepared as described in published PCT applications WO 94/17093 and WO 94/02499. 3'-Deoxy-3'-amino phosphoramidate oligonucleotides may be prepared as described in U.S. Pat. No. 5,476,925. Phosphotriester oligonucleotides may be prepared as described in U.S. Pat. No. 5,023,243. Borano phosphate oligonucleotides may be prepared as described in U.S. Pat. Nos. 5,130,302 and 5,177,198.

The polynucleotide sequences of the invention may be prepared by any known method, including synthetic, recombinant, ex vivo generation, or a combination thereof, as well as utilizing any purification methods known in the art.

In specific embodiments, the polynucleotides of the invention are at least 15, at least 30, at least 50, at least 100, at least 125, at least 500, or at least 1000 continuous nucleotides but are less than or equal to 300 kb, 200 kb, 100 kb, 50 kb, 10 kb, 7.5 kb, 5 kb, 2.5 kb, 2 kb, 1.5 kb, or 1 kb in length. In a further embodiment, polynucleotides of the invention comprise a portion of the coding sequences, as disclosed herein, but do not comprise all or a portion of any intron. In another embodiment, the polynucleotides comprising coding sequences do not contain coding sequences of a genomic flanking gene (i.e., 5' or 3' to the gene of interest in the genome). In other embodiments, the polynucleotides of the invention do not contain the coding sequence of more than 1000, 500, 250, 100, 75, 50, 25, 20, 15, 10, 5, 4, 3, 2, or 1 genomic flanking gene(s).

The terms "base paired" and "Watson & Crick base paired" are used interchangeably herein to refer to nucleotides which can be hydrogen bonded to one another by virtue of their sequence identities in a manner like that found in double-helical DNA with thymine or uracil residues linked to adenine residues by two hydrogen bonds and cytosine and guanine residues linked by three hydrogen bonds (See Stryer, *Biochemistry*, 4th edition, 1995).

The terms "complementary" or "complement thereof" are used herein to refer to the sequences of polynucleotides which is capable of forming Watson & Crick base pairing with another specified polynucleotide throughout the entirety of the complementary region. For the purpose of the present invention, a first polynucleotide is deemed to be complementary to a second polynucleotide when each base in the first polynucleotide is paired with its complementary base. Complementary bases are, generally, A and T (or A and U), or C and G. "Complement" is used herein as a synonym from "complementary polynucleotide", "complementary nucleic acid" and "complementary nucleotide sequence". These terms are applied to pairs of polynucleotides based solely upon their sequences and not any particular set of conditions under which the two polynucleotides would actually bind. Preferably, a "complementary" sequence is a sequence which an A at each position where there is a T on the opposite strand, a T at each position where there is an A on the opposite strand, a G at each position where there is a C on the opposite strand and a C at each position where there is a G on the opposite strand. Unless otherwise indicated, a "complementary" sequence is fully complementary.

Thus, 5' ESTs in cDNA libraries in which one or more 5' ESTs make up 5% or more of the number of nucleic acid inserts in the backbone molecules are "enriched recombinant 5' ESTs" as defined herein. Likewise, 5' ESTs in a population of plasmids in which one or more 5' EST of the present invention have been inserted such that they represent 5% or more of the number of inserts in the plasmid backbone are "enriched recombinant 5' ESTs" as defined herein. However, 5' ESTs in cDNA libraries in which 5' ESTs constitute less than 5% of the number of nucleic acid inserts in the population of backbone molecules, such as libraries in which backbone molecules having a 5' EST insert are extremely rare, are not "enriched recombinant 5' ESTs."

In particular, the present invention relates to 5' ESTs which are derived from genes encoding secreted proteins. As used herein, a "secreted" protein is one which, when expressed in a suitable host cell, is transported across or through a membrane, including transport as a result of signal peptides in its amino acid sequence. "Secreted" proteins include without limitation proteins secreted wholly (e.g. soluble proteins), or partially (e.g. receptors) from the cell in which they are expressed. "Secreted" proteins also include without limitation proteins which are transported across the membrane of the endoplasmic reticulum.

Such 5' ESTs include nucleic acid sequences, called signal sequences, which encode signal peptides which direct the extracellular secretion of the proteins encoded by the genes from which the 5' ESTs are derived. Generally, the signal peptides are located at the amino termini of secreted proteins. Polypeptides comprising these signal peptides (as delineated in the sequence listing), and polynucleotides encoding the same, are preferred embodiments of the present invention.

Secreted proteins are translated by ribosomes associated with the "rough" endoplasmic reticulum. Generally, secreted proteins are co-translationally transferred to the membrane of the endoplasmic reticulum. Association of the ribosome with the endoplasmic reticulum during translation of secreted proteins is mediated by the signal peptide. The signal peptide is typically cleaved following its co-translational entry into the endoplasmic reticulum. After delivery to the endoplasmic reticulum, secreted proteins may proceed through the Golgi apparatus. In the Golgi apparatus, the proteins may undergo post-translational modification before entering secretory vesicles which transport them across the cell membrane.

The 5' ESTs of the present invention have several important applications. For example, the 5' EST sequences of the sequence listing, and fragments thereof, may be used to distinguish human tissues/cells from non-human tissues/cells and to distinguish between human tissues/cells that do and do not express the polynucleotides comprising the 5' EST sequences. By knowing the tissue expression pattern of the 5' EST sequences, either through routine experimentation or by using the Tables herein, the polynucleotides of the present invention may be used in methods of determining the identity of an unknown tissue/cell sample. As part of determing the identity of an unknown tissue/cell sample, the 5' EST sequences may be used to determine what the unknown tissue/cell sample is and what it is not. For example, if a 5' EST is expressed in a particular tissue/cell type, as shown in the Tables below, and the unknown tissue/cell sample does not express the 5' EST, it may be inferred that the unknown tissue/cells are either not human or not the same human tissue/cell type as that which expresses the 5' EST. These methods of determining tissue/cell identity are are based on methods which detect the presence or absence of the 5' EST sequences in a tissue/cell sample using methods well know in the art (e.g., hybridization or PCR methods).

Another use of the polynucleotides of the present invention is to map open reading flumes from a genomic sequence. For example, the 5' ESTs can be used in combination with the sequence information from genome sequencing projects, such as the U.S. Human Genome Project or other public and private genome sequencing projects, to map regions of the genome that comprise expressed open reading frames. The polynucleotides of the present invention are particularly useful for mapping and identifying coding regions (regions containing expressed open reading frames) from a genomic sequence since the vast majority of the human genome does not encode expressed genes and since it is difficult to identify authentic open reading frames (open reading frames that encode expressed genes).

As described below, the polynucleotides of the present invention may also be used to design probes or primers which may be used to identify a cell containing a polynucleotide of the present invention, or a portion thereof, and to clone a nucleic acid comprising a polynucleotide of the present invention, or a portion thereof, which is contained in a nucleic acid library into a desired vector. For example, as described below, nucleic acids from cells containing a cDNA or genomic DNA library, such as the genomic fragments generated by the U.S. Human Genome Project or other public and private genome sequencing projects, may be contacted with a detectable probe comprising a polynucleotide of the present invention or a portion thereof under conditions in which the probe will specifically hybridize to complementary nucleic acids. In this way, clones in the library which contain sequences encoding secreted polypeptides may be identified and their inserts may be cloned into a desired vector. In some embodiment, inserts in a genomic library which contain sequences encoding the secreted polypeptides of the present invention may be obtained from the library by performing an amplification reaction, such as a PCR reaction, using one or more primers based on the polynucleotides of the present invention. The amplification product is then cloned into a desired vector. In some embodiments, the amplification product may be inserted into an expression vector such that a sequence which includes a coding region encoding the amino terminal region of a secreted polynucleotide is operably linked to a promoter. In some embodiments, a coding region encoding an entire secreted protein, or a desired portion thereof, is operably linked to the promoter. The expression vector is introduced into a suitable host cell and the protein encoded by the amplification product is produced.

In other useful applications, fragments of the 5' EST sequences encoding signal peptides as well as degenerate polynucleotides encoding the same, may be ligated to sequences encoding either the polypeptide from the same gene or to sequences encoding a heterologous polypeptide to facilitate secretion The 5' EST sequences, and fragments thereof, may also be used to obtain and express extended cDNAs encoding portions of the secreted protein. The portions may comprise the signal peptides of the secreted proteins or the mature proteins generated when the signal peptide is cleaved off. The portions may also comprise polypeptides having at least 6, 8, 10, 12, 15, 18, 20, 23, 25, 28, 30, 35, 40, or 50 consecutive amino acids encoded by the extended cDNAs or full length cDNAs.

Antibodies which specifically recognize the entire secreted proteins encoded by the extended cDNAs, full length cDNAs, or fragments thereof having at least 6, 8, 10, 12, 15, 18, 20, 23, 25, 28, 30, 35, 40, or 50 consecutive amino acids may also be obtained as described below. Antibodies which specifically recognize the mature protein generated when the signal peptide is cleaved may also be obtained as described below. Similarly, antibodies which specifically recognize the signal peptides encoded by the extended cDNAs or full length cDNAs may also be obtained. These antibodies are useful in determining the tissue type or species of origin of a biological sample. For example, to distinguish between human and non-human cells and tissues or to distinguish between human tissues that do and do not express the polypeptides.

In some embodiments, the extended cDNAs obtained using the 5' ESTs include the signal sequence. In other embodiments, the extended cDNAs obtained using the 5' ESTs may include the full coding sequence for the mature protein (i.e. the protein generated when the signal polypeptide is cleaved off). In addition, the extended cDNAs obtained using the 5' ESTs may include regulatory regions upstream of the translation start site or downstream of the stop codon which control the amount, location, or developmental stage of gene expression.

As discussed above, secreted proteins are therapeutically important. Thus, the proteins expressed from the extended cDNAs or full length cDNAs obtained using the 5' ESTs may be useful in treating or controlling a variety of human conditions.

The 5' ESTs (or cDNAs or genomic DNAs obtained therefrom) may be used in forensic procedures to identify individuals or in diagnostic procedures to identify individuals having genetic diseases resulting from abnormal expression of the genes corresponding to the 5' ESTs. In addition, the present invention is useful for constructing a high resolution map of the human chromosomes.

The present invention also relates to secretion vectors capable of directing the secretion of a protein of interest. Such vectors may be used in gene therapy strategies in which it is desired to produce a gene product in one cell which is to be delivered to another location in the body. Secretion vectors may also facilitate the purification of desired proteins. The secretion vectors may also be used to express a desired protein, such as a heterologous protein, such that the protein is secreted into the culture medium, thereby facilitating purification.

The present invention also relates to expression vectors capable of directing the expression of an inserted gene in a desired spatial or temporal manner or at a desired level. Such vectors may include sequences upstream of the 5' ESTs, such as promoters or upstream regulatory sequences. Preferred chimeric polypeptides, and vectors encoding the same, comprise a signal peptide set forth in the sequence listing below.

Finally, the present invention may also be used for gene therapy to control or treat genetic diseases. Signal peptides may also be fused to heterologous proteins to direct their extracellular secretion.

Bacterial clones containing Bluescript plasmids having inserts containing the 5' ESTs of the present invention (SEQ ID NOs: 38-1756) are presently stored at −80° C. in 4% (v/v) glycerol in the inventor's laboratories under the designations listed next tote SEQ ID NOs in Table II. The inserts may be recovered from the stored materials by growing the appropriate clones on a suitable medium. The Bluescript DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the EST insertion. The PCR product which corresponds to the 5' EST can then be manipulated using standard cloning techniques familiar to those skilled in the art.

One aspect of the present invention is a purified or isolated nucleic acid having the sequence of one of SEQ ID NOs: 38-1756 or having a sequence complementary thereto. In one embodiment, the nucleic acid is recombinant.

Another aspect of the present invention is a purified or isolated nucleic acid comprising at least 8, 10, 12, 15, 20, 23, 25, 28, 30, 35, 40, 50, 75, 100, 200, 300, 500, or more than 500 consecutive nucleotides, to the extent that sequences of these lengths are consistent with the specific sequence, of the sequence of one of SEQ ID NOs: 38-1756 or one of the sequences complementary thereto. In one embodiment, the nucleic acid is recombinant.

A further aspect of the present invention is a purified or isolated nucleic acid of at least 8, 10, 12, 15, 20, 23, 25, 28, 30, 35, 40, 50, 75, 100, 200, 300, 500, or more than 500 nucleotides which is capable of hybridizing under stringent conditions to the sequence of one of SEQ ID NOs: 38-1756 or one of the sequences complementary to the sequences of SEQ ID NOs: 38-1756. In one embodiment, the nucleic acid is recombinant.

Another aspect of the present invention is a purified or isolated nucleic acid encoding a human gene product, said human gene product having a sequence partially encoded by one of the sequences of SEQ ID NO: 38-1756.

Still another aspect of the present invention is a method of making a cDNA encoding a human secretory protein, said human secretory protein being partially encoded by one of SEQ ID NOs 38-1756, comprising the steps of contacting a collection of mRNA molecules from human cells with a primer comprising at least 8, 10, 15, 20, 25, 30, 35, 40 or more than 40 consecutive nucleotides of a sequence complementary to one of SEQ ID NOs: 38-1756; hybridizing said primer to an mRNA in said collection that encodes said protein; reverse transcribing said hybridized primer to make a first cDNA strand from said mRNA; making a second cDNA strand complementary to said first cDNA strand; and isolating the resulting cDNA encoding said protein comprising said first cDNA strand and said second cDNA strand.

Another aspect of the invention is an isolated or purified cDNA encoding a human secretory protein, said human secretory protein comprising the protein encoded by one of SEQ ID NOs 38-1756 or a fragment thereof of at least 6, 8, 10, 12, 15, 18, 20, 23, 25, 28, 30, 35, 40, or 50 amino acids, said cDNA being obtainable by the method described in the preceding paragraph.

In one embodiment, the cDNA comprises the full protein coding sequence of said protein which sequence is partially included in one of the sequences of SEQ ID NOs: 38-1756.

Another aspect of the present invention is a method of making a cDNA encoding a human secretory protein that is partially encoded by one of SEQ ID NOs 38-1756, comprising the steps of obtaining a cDNA comprising one of the sequences of SEQ ID NOs: 38-1756; contacting said cDNA with a detectable probe comprising at least 10, 15, 20, 25, 30, 35, 40 or more than 40 consecutive nucleotides of said sequence of SEQ ID NO: 38-1756 or a sequence complementary thereto under conditions which permit said probe to hybridize to said cDNA; identifying a cDNA which hybridizes to said detectable probe; and isolating said cDNA which hybridizes to said probe.

Another aspect of the present invention is an isolated or purified cDNA encoding a human secretory protein, said human secretory protein comprising the protein encoded by one of SEQ ID NOs 38-1756 or a fragment thereof of at least 6, 8, 10, 12, 15, 18, 20, 23, 25, 28, 30, 35, 40, or 50 amino acids, said cDNA being obtainable by the method described in the preceding paragraph. In one embodiment, the cDNA comprises the full protein coding sequence partially included in one of the sequences of SEQ ID NOs: 38-1756.

Another aspect of the present invention is a method of making a cDNA comprising the sequence of SEQ ID NOs: 38-1756, comprising the steps of contacting a collection of mRNA molecules from human cells with a first primer capable of hybridizing to the polyA tail of said mRNA; hybridizing said first primer to said polyA tail; reverse transcribing said mRNA to make a first cDNA strand; making a second cDNA strand complementary to said first cDNA strand using at least one primer comprising at least 15 nucleotides of one of the sequences of SEQ ID NOs 38-1756; and isolating the resulting cDNA comprising said first cDNA strand and said second cDNA strand. The term "capable of hybridizing to the polyA tail of said mRNA" refers to and embraces all primers containing stretches of thymidine residues, so-called oligo(dT) primers, that hybridize to the 3' end of eukaryotic poly(A)+ mRNAs to prime the synthesis of a first cDNA strand. Techniques for generating said oligo(dT) primers and hybridizing them to mRNA to subsequently prime the reverse transcription of said hybridized mRNA to generate a first cDNA strand are well known to those skilled in the art and are described in *Current Protocols in Molecular Biology*, John Wiley and Sons, Inc. 1997 and Sambrook et al., *Molecular Cloning: A Laboratory Manual*, Second Edition, Cold Spring Harbor Laboratory Press, 1989, the entire disclosures of which are incorporated herein by reference. Preferably, said oligo(dT) primers are present in a large excess in order to allow the hybridization of all mRNA 3' ends to at least one oligo(dT) molecule. The priming and reverse transcription step are preferably performed between 37° C. and 55° C. depending on the type of reverse transcriptase used.

Preferred oligo(dT) primers for priming reverse transcription of mRNAs are oligonucleotides containing a stretch of thymidine residues of sufficient length to hybridize specifically to the polyA tail of mRNAs, preferably of 12 to 18 thymidine residues in length. More preferably, such oligo(T) primers comprise an additional sequence upstream of the poly(dT) stretch in order to allow the addition of a given sequence to the 5' end of all first cDNA strands which may then be used to facilitate subsequent manipulation of the cDNA. Preferably, this added sequence is 8 to 60 residues in length. For instance, the addition of a restriction site in 5' of cDNAs facilitates subcloning of the obtained cDNA. Alternatively, such an added 5' end may also be used to design primers of PCR to specifically amplify cDNA clones of interest.

Another aspect of the present invention is an isolated or purified cDNA encoding a human secretory protein, said human secretory protein comprising the protein encoded by one of SEQ ID NOs 38-1756 or a fragment thereof of at least 6, 8, 10, 12, 15, 18, 20, 23, 25, 28, 30, 35, 40, or 50 amino acids, said cDNA being obtainable by the method described in the preceding paragraph. In one embodiment, the cDNA comprises the full protein coding sequence partially included in one of the sequences of SEQ ID NOs: 38-1756.

In one embodiment of the method described in the paragraph two paragraphs above, the second cDNA strand is made by contacting said first cDNA strand with a first pair of primers, said first pair of primers comprising a second primer comprising at least 10, 15, 20, 25, 30, 35, or 40 consecutive nucleotides of one of the sequences of SEQ ID NOs 38-1756 and a third primer having a sequence therein which is included within the sequence of said first primer; performing a first polymerase chain reaction with said first pair of nested primers to generate a first PCR product; contacting said first PCR product with a second pair of primers, said second pair of primers comprising a fourth primer, said fourth primer comprising at least 10, 15, 20, 25, 30, 35 or 40 consecutive nucleotides of said sequence of one of SEQ ID NO:s 38-1756, and a fifth primer, said fourth and fifth primers being capable of hybridizing to sequences within said first PCR product; and performing a second polymerase chain reaction, thereby generating a second PCR product.

One aspect of the present invention is an isolated or purified cDNA encoding a human secretory protein, said human secretory protein comprising the protein encoded by one of SEQ ID NOs 38-1756, or a fragment thereof oat least 6, 8, 10, 12, 15, 18, 20, 23, 25, 28, 30, 35, 40, or 50 amino acids, said cDNA being obtainable by the method of the preceding paragraph. In one embodiment, the cDNA comprises the full protein coding sequence partially included in one of the sequences of SEQ ID NOs: 38-1756.

Another aspect of the present invention is the method described four paragraphs above in which the second cDNA strand is made by contacting said first cDNA strand with a second primer comprising at least 10, 15, 20, 25, 30, 35 or 40 consecutive nucleotides of the sequences of SEQ ID NOs: 38-1756; hybridizing said second primer to said first strand cDNA; and extending said hybridized second primer to generate said second cDNA strand.

Another aspect of the present invention is an isolated or purified cDNA encoding a human secretory protein, said human secretory protein comprising the protein partially encoded by one of SEQ ID NOs 38-1756 or comprising a fragment thereof of at least 6, 8, 10, 12, 15, 18, 20, 23, 25, 28, 30, 35, 40, or 50 amino acids, said cDNA being obtainable by the method described in the preceding paragraph. In one embodiment, the cDNA comprises the full protein coding sequence partially included in of one of the sequences of SEQ ID NOs: 38-1756.

The present invention also includes isolated or purified "positional segments of polypeptides of SEQ ID NOs: 1757-3475." As used herein, the term "positional segments of polypeptides of SEQ ID NOs: 1757-3475" includes polypeptides comprising amino acid residues 1-25, 26-50, 51-75, 76-100, 101-125, 126-150, 151-175, 176-200, or 201—the C-terminal amino acid of the polypeptides of SEQ ID NOs:

1757-3475, to the extent that such amino acid residues are consistent with the lengths of the particular polypeptides being referred to. The term "positional segments of EST-related polypeptides also includes segments comprising amino acid residues 1-50, 51-100, 101-150, 151-200 or 201—the C-terminal amino acid of the polypeptides of SEQ ID NOs: 1757-3475, to the extent that such amino acid residues are consistent with the lengths of the particular polypeptide being referred to. The term "positional segments of polypeptides of SEQ ID NOs: 1757-3475" also includes segments comprising amino acids 1-100 or 101-200 of the polypeptides polypeptides of SEQ ID NOs: 1757-3475 to the extent that such amino acid residues are consistent with the lengths of particular polypeptides being referred to. In addition, the term "positional segments of polypeptides of SEQ ID NOs: 1757-3475" includes segments comprising amino acid residues 1-200 or 201—the C-terminal amino acid of the polypeptides of SEQ ID NOs: 1757-3475, to the extent that amino acid residues are consistent with the lengths of the particular polypeptide being referred to.

The present invention also includes isolated or purified "fragments of positional segments of the polypeptides of SEQ ID NOs: 1757-3475." The terms "isolated" or "purified" have the meanings provided above. As used herein, the term "fragments of positional segments of the polypeptides of SEQ ID NOs: 1757-3475" means fragments comprising at least 5, 10, 15, 20, 25, 30, 35, 40, 50, 75, 100, or 150 consecutive amino acids of positional segments of the polypeptides of SEQ ID NOs: 1757-3475, to the extent that fragments of these lengths are consistent with the lengths of the particular polypeptides being referred to.

In addition to the "positional segments of polypeptides of SEQ ID NOs: 1757-3475" and "fragments of positional segments of polypeptides of SEQ ID NOs: 1757-3475", for the polypeptides of the present invention, further preferred polypeptides comprise at least 8 amino acids, wherein "at least 8" is defined as any integer between 8 and the integer representing the C-terminal amino acid of the polypeptide of the present invention including the polypeptide sequences of the sequence listing below. Further included are polypeptide fragments at least 8 amino acids in length, as described above, that are further specified in terms of their N-terminal and C-terminal positions. Preferred polypeptide fragments specified by their N-terminal and C-terminal positions include the signal peptides delineated in the sequence listing below. However, included in the present invention as individual species are all polypeptide fragments, at least 5 amino acids in length, as described above, and may be particularly specified by a N-terminal and C-terminal position.

The present invention also provides for the exclusion of any fragments specified by N-terminal and C-terminal positions or by size in amino acid residues as described above. Any number of fragments specified by N-terminal and C-terminal positions or by size in amino acid residues as described above may be excluded as individual species.

The polypeptide fragments of the present invention can be immediately envisaged using the above description and are therefore not individually listed solely for the purpose of not unnecessarily lengthening the specification. The above fragments need not be active since they would be useful, for example, in immunoassays, in epitope mapping, epitope tagging, as vaccines, and as molecular weight markers. The above fragments may also be used to generate antibodies to a particular portion of the polypeptide. These antibodies can then be used in immunoassays well known in the art to distinguish between human and non-human cells and tissues or to determine whether cells or tissues in a biological sample are or are not of the same type which express the polypeptide of the present invention. Further preferred polypeptide fragments of the present invention comprise the signal peptides as delineated in the sequence listing. These signal peptides may be used to facilitate secretion of either the polypeptide of the same gene or a heterologous polypeptide.

Another aspect of the present invention is a method of making a protein comprising one of the sequences of SEQ ID NO: 1757-3475, comprising the steps of obtaining a cDNA encoding the full protein sequence partially included in one of the sequences of sequence of SEQ ID NO: 38-1756; inserting said cDNA in an expression vector such that said cDNA is operably linked to a promoter; introducing said expression vector into a host cell whereby said host cell produces the protein encoded by said cDNA; and isolating said protein.

Another aspect of the present invention is an isolated protein obtainable by the method described in the preceding paragraph.

Another aspect of the present invention is a method of obtaining a promoter DNA comprising the steps of obtaining DNAs located upstream of the nucleic acids of SEQ ID NO: 38-1756 or the sequences complementary thereto; screening said upstream DNAs to identify a promoter capable of directing transcription initiation; and isolating said DNA comprising said identified promoter. In one embodiment, the obtaining step comprises chromosome walking from said nucleic acids of SEQ ID NO: 38-1756 or sequences complementary thereto. In another embodiment, the screening step comprises inserting said upstream sequences into a promoter reporter vector. In another embodiment, the screening step comprises identifying motifs in said upstream DNAs which are transcription factor binding sites or transcription start sites.

Another aspect of the present invention is an isolated promoter obtainable by the method described above.

Another aspect of the present invention is an isolated or purified protein comprising one of the sequences of SEQ ID NO: 1757-3475.

Another aspect of the present invention is the inclusion of at least one of the sequences of SEQ ID NOs: 38-1756, or one of the sequences complementary to the sequences of SEQ ID NOs: 38-1756, or a fragment thereof of at least 8, 10, 12, 15, 20, 23, 25, 28, 30, 35, 40, 50, 75 or 100 consecutive nucleotides in an array of discrete ESTs or fragments thereof. In one embodiment, the array includes at least two of the sequences of SEQ ID NOs: 38-1756, the sequences complementary to the sequences of SEQ ID NOs: 38-1756, or fragments thereof of at least 8, 10, 12, 15, 20, 23, 25, 28, 30, 35, 40, 50, 75, or 100 consecutive nucleotides. In another embodiment, the array includes at least five of the sequences of SEQ ID NOs: 38-1756, the sequences complementary to the sequences of SEQ ID NOs: 38-1756, or fragments thereof of at least 8, 10, 12, 15, 20, 23, 25, 28, 30, 35, 40, 50, 75, or 100 consecutive nucleotides.

The present invention also includes isolated, purified, or enriched "positional segments of the 5' ESTs (or cDNAs or genomic DNAs obtainable therefrom)." The terms "isolated", "purified", or "enriched" have the meanings provided above. As used herein, the term "positional segments of 5' ESTs (or cDNAs or genomic DNAs obtainable therefrom)" includes segments comprising nucleotides 1-25, 26-50, 51-75, 76-100, 101-125, 126-150, 151-175, 176-200, 201-225, 226-250, 251-300, 301-325, 326-350, 351-375, 376-400, 401-425, 426-450, 451-475, 476-500, 501-the terminal nucleotide of the 5' ESTs (or cDNAs or genomic DNAs obtainable therefrom) to the extent that such nucleotide positions are consistent with the lengths of the particular 5' ESTs (or cDNAs or genomic DNAs obtainable therefrom) being referred to, and wherein position "1" is defined as the 5' most position defined in the sequence listing or Tables below. The term "positional segments of 5' ESTs (or cDNAs or genomic DNAs obtainable therefrom)" also includes segments comprising nucleotides 1-50, 51-100, 101-150, 151-200, 201-250, 251-300, 301-350, 351-400, 401-450, 450-500, 501-550, 551-600 or 601—the terminal nucleotide of the 5' ESTs (or cDNAs or genomic DNAs obtainable therefrom) to the extent that such nucleotide positions are consistent with the lengths of the particular 5' ESTs (or cDNAs or genomic DNAs obtainable therefrom) being referred to. The term "positional segments of 5' ESTs (or cDNAs or genomic DNAs obtainable therefrom)" also includes segments comprising nucleotides 1-100, 101-200, 201-300, 301-400, 501-500, 500-600, or 601—the terminal nucleotide of the 5' ESTs (or cDNAs or genomic DNAs obtainable therefrom) to the extent that such nucleotide positions are consistent with the lengths of the particular 5' ESTs (or cDNAs or genomic DNAs obtainable therefrom) being referred to. In addition, the term "positional segments of 5' ESTs (or cDNAs or genomic DNAs obtainable therefrom)" includes segments comprising nucleotides 1-200, 201-400, 400-600, or 601 —the terminal nucleotide of the 5' ESTs (or cDNAs or genomic DNAs obtainable therefrom) to the extent that such nucleotide positions are consistent with the lengths of the particular 5' ESTs (or cDNAs or genomic DNAs obtainable therefrom) being referred to. The present invention also includes the sequences complementary to the positional segments of 5' ESTs (or cDNAs or genomic DNAs obtainable therefrom).

The present invention also includes isolated, purified, or enriched "fragments of positional segments of 5' ESTs (or cDNAs or genomic DNAs obtainable therefrom)." The terms "isolated", "purified", or "enriched" have the meanings provided above. As used herein, the term "fragments of positional segments of 5' ESTs (or cDNAs or genomic DNAs obtainable therefrom)" refers to fragments comprising at least 8, 10, 15, 18, 20, 23, 25, 28, 30, 35, 40, 50, 75, 100, 150, or 200 consecutive nucleotides of the positional segments of 5' ESTs (or cDNAs or genomic DNAs obtainable therefrom). The present invention also includes the sequences complementary to the fragments of positional segments of 5' ESTs (or cDNAs or genomic DNAs obtainable therefrom).

In addition to the "positional segments of 5' ESTs (or cDNAs or genomic DNAs obtainable therefrom)" and "fragments of positional segments of 5' ESTs (or cDNAs or genomic DNAs obtainable therefrom)", for the nucleic acids of SEQ ID NOs.38-1756, further preferred nucleic acids comprise at least 8 nucleotides, wherein "at least 8" is defined as any integer between 8 and the integer representing the 3' most nucleotide position in the sequence listing or Tables below. Further included are nucleic acid fragments at least 8 nucleotides in length, as described above, that are further specified in terms of their 5' and 3' position. The 5' and 3' positions are represented by the position number set forth in the sequence listing below. Therefore, every combination of a 5' and 3' nucleotide position that a fragment at least 8 contiguous nucleotides in length could occupy is included in the invention as an individual species. The polynucleotide fragment specified by 5' and 3' positions can be immediately envisaged and are therefore not individually listed solely for the purpose of not unnecessarily lengthening the specifications. It is noted that the above species of polynucleotides fragments of the present invention may alternatively be described by the formula "a to b"; where "a" equals the 5' nucleotide position and "b" equals 3' nucleotide position of the polynucleotide fragment; and further where "a" equals an integer between 1 and the number of nucleotides of the polynucleotide sequence of the present invention minus 8, and where "b" equals an integer between 9 and the number of nucleotides of the polynucleotide sequence of the present invention; and where "a" is an integer smaller then "b" by at least 8.

The present invention also provides for the exclusion of any polynucleotide fragments specified by 5' and 3' positions or by size in nucleotides as described above. Any number of fragments specified by 5' and 3' positions or by size in nucleotides, as described above, may be excluded.

BRIEF DESCRIPTION OF THE DRAWINGS

FIG. 2 is an analysis of the 43 amino terminal amino acids of all human SwissProt proteins to determine the frequency of false positives and false negatives using the techniques for signal peptide identification described herein.

FIG. 4 shows the distribution of 5' ESTs in each category and the number of 5' ESTs in each category having a given minimnum von Heijne's score.

FIG. 5 shows the tissues from which the mRNAs corresponding to the 5' ESTs in each of the categories described herein were obtained.

FIG. 6 provides a schematic description of the promoters isolated and the way they are assembled with the corresponding 5' tags.

FIG. 7 describes the transcription factor binding sites present in each of these promoters.

DETAILED DESCRIPTION OF THE PREFERRED EMBODIMENT

I. Obtaining 5' ESTs

Figure 1:
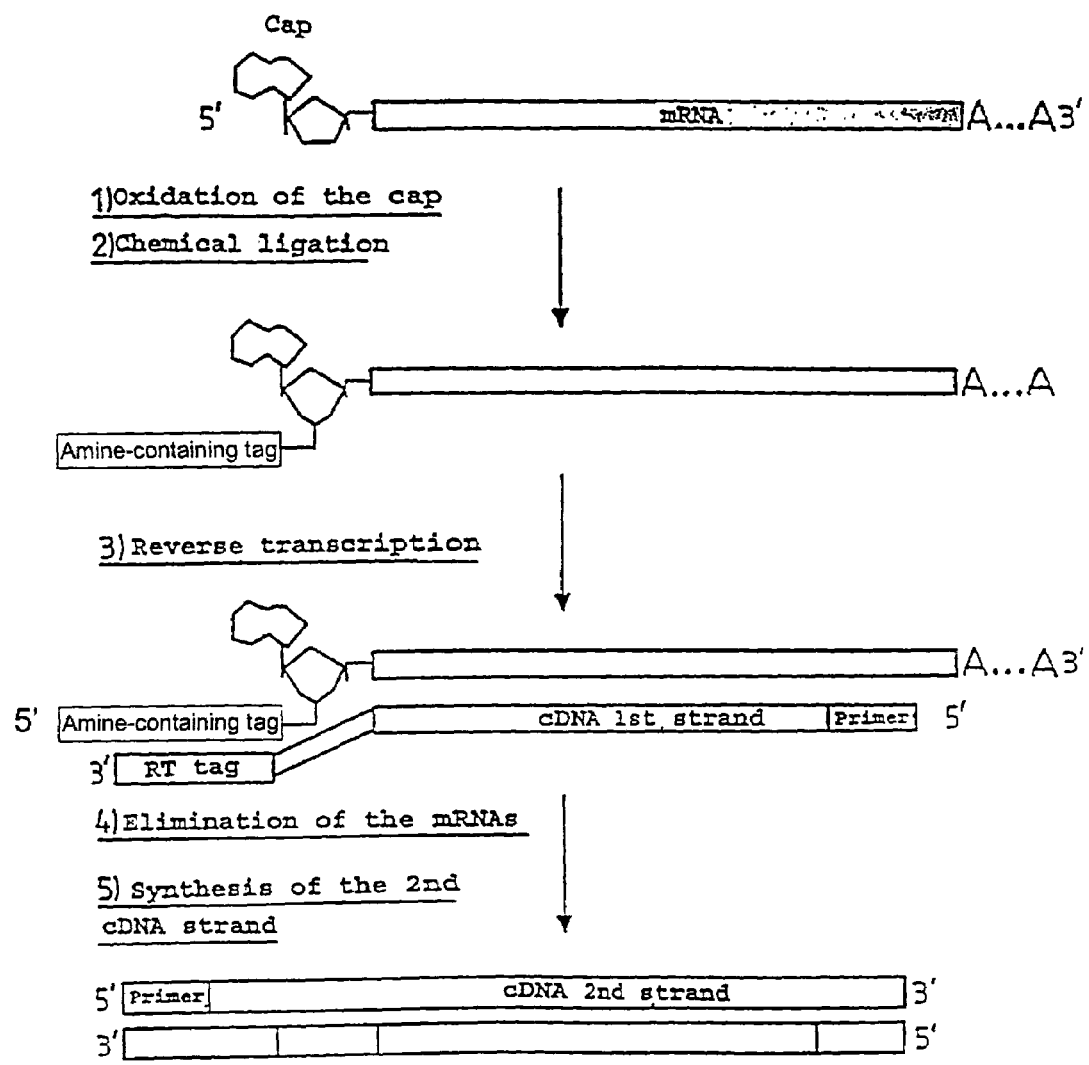
FIG. 1 is a summary of a procedure for obtaining cDNAs which have been selected to include the 5' ends of the mRNAs from which they are derived.

A. Chemical Methods for Obtaining mRNAs having Intact 5' Ends

In order to obtain the 5' ESTs of the present invention, mRNAs having intact 5' ends must be obtained. Currently, there are two approaches for obtaining such mRNAs. One of these approaches is a chemical modification method involving derivatization of the 5' ends of the mRNAs and selection of the derivatized mRNAs. The 5' ends of eucaryotic mRNAs possess a structure referred to as a "cap" which comprises a guanosine methylated at the 7 position. The cap is joined to the first transcribed base of the mRNA by a 5',5'-triphosphate bond. In some instances, the 5' guanosine is methylated in both the 2 and 7 positions. Rarely, the 5' guanosine is trimethylated at the 2, 7 and 7 positions.

In the chemical method for obtaining mRNAs having intact 5' ends, the 5' cap is specifically derivatized and coupled to a reactive group on an immobilizing substrate. This specific derivatization is based on the fact that only the ribose linked to the methylated guanosine at the 5' end of the mRNA and the ribose linked to the base at the 3' terminus of the mRNA, possess 2',3'-cis diols. Optionally, where the 3' terminal ribose has a 2',3'-cis diol, the 2',3'-cis diol at the 3' end may be chemically modified, substituted, converted, or eliminated, leaving only the ribose linked to the methylated guanosine at the 5' end of the mRNA with a 2',3'-cis diol. A variety of techniques are available for eliminating the 2',3'-cis diol on the 3' terminal ribose. For example, controlled alkaline hydrolysis may be used to generate mRNA fragments in which the 3' terminal ribose is a 3'-phosphate, 2'-phosphate or (2',3')-cyclophosphate. Thereafter, the fragment which includes the original 3' ribose may be eliminated from the mixture through chromatography on an oligo-dT column. Alternatively, a base which lacks the 2',3'-cis diol may be added to the 3' end of the mRNA using an RNA ligase such as T4 RNA ligase. Example 1 below describes a method for ligation of pCp to the 3' end of messenger RNA.

EXAMPLE 1

Ligation of the Nucleoside Diphosphate pCp to the 3' End of Messenger RNA

1 µg of RNA was incubated in a final reaction medium of 10 µl in the presence of 5 U of T$_4$ phage RNA ligase in the buffer provided by the manufacturer (Gibco-BRL), 40 U of the RNase inhibitor RNasin (Promega) and, 2 µl of $^{32}$pCp (Amersham #PB 10208).

The incubation was performed at 37° C. for 2 hours or overnight at 7-8° C.

Following modification or elimination of the 2',3'-cis diol at the 3' ribose, the 2',3'-cis diol present at the 5' end of the mRNA may be oxidized using reagents such as NABH$_4$, NaBH$_3$CN, or sodium periodate, thereby converting the 2',3'-cis diol to a dialdehyde. Example 2 describes the oxidation of the 2',3'-cis diol at the 5' end of the mRNA with sodium periodate.

EXAMPLE 2

Oxidation of 2',3'-cis diol at the 5' End of the mRNA 0.1 OD unit of either a capped oligoribonucleotide of 47 nucleotides (including the cap) or an uncapped oligoribonucleotide of 46 nucleotides were treated as follows. The oligoribonucleotides were produced by in vitro transcription using the transcription kit "AmpliScribe T7" (Epicentre Technologies). As indicated below, the DNA template for the RNA transcript contained a single cytosine. To synthesize the uncapped RNA, all four NTPs were included in the in vitro transcription reaction. To obtain the capped RNA, GTP was replaced by an analogue of the cap, m7G(5')ppp(5')G. This compound, recognized by polymerase, was incorporated into the 5' end of the nascent transcript during the step of initiation of transcription but was not capable of incorporation during the extension step. Consequently, the resulting RNA contained a cap at its 5' end. The sequences of the oligoribonucleotides produced by the in vitro transcription reaction were:

+Cap:

(SEQ ID NO:1)
5'm7GpppGCAUCCUACUCCCAUCCAAUUCCACCCUAACUCCUCCCAUCU
CCAC-3'

−Cap:

(SEQ ID NO:2)
5'-pppGCAUCCUACUCCCAUCCAAUUCCACCCUAACUCCUCCCAUCUCC
AC-3'

The oligoribonucleotides were dissolved in 9 µl of acetate buffer (0.1 M sodium acetate, pH 5.2) and 3 µl of freshly prepared 0.1 M sodium periodate solution. The mixture was incubated for 1 hour in the dark at 4° C. or room temperature. Thereafter, the reaction was stopped by adding 4 µl of 10% ethylene glycol. The product was ethanol precipitated, resuspended in 10 µl or more of water or appropriate buffer and dialyzed against water.

The resulting aldehyde groups may then be coupled to molecules having a reactive amine group, such as hydrazine, carbazide, thiocarbazide or semicarbazide groups, in order to facilitate enrichment of the 5' ends of the mRNAs. Molecules having reactive amine groups which are suitable for use in selecting mRNAs having intact 5' ends include avidin, proteins, antibodies, vitamins, ligands capable of specifically binding to receptor molecules, or oligonucleotides. Example 3 below describes the coupling of the resulting dialdehyde to biotin.

EXAMPLE 3

Coupling of the Dialdehyde with Biotin

The oxidation product obtained in Example 2 was dissolved in 50 µl of sodium acetate at a pH of between 5 and 5.2 and 50 µl of freshly prepared 0.02 M solution of biotin hydrazide in a methoxyethanol/water mixture (1:1) of formula:

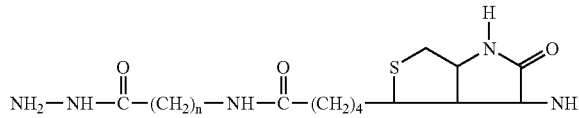

In the compound used in these experiments, n=5. However, it will be appreciated that other commercially available hydrazides may also be used, such as molecules of the formula above in which n varies from 0 to 5.

The mixture was then incubated for 2 hours at 37° C. Following the incubation, the mixture was precipitated with ethanol and dialyzed against distilled water.

Example 4 demonstrates the specificity of the biotinylation reaction.

EXAMPLE 4

Specificity of Biotinylation

The specificity of the biotinylation for capped mRNAs was evaluated by gel electrophoresis of the following samples:

Sample 1. The 46 nucleotide uncapped in vitro transcript prepared as in Example 2 and labeled with $^{32}$pCp as described in Example 1.

Sample 2. The 46 nucleotide uncapped in vitro transcript prepared as in Example 2, labeled with $^{32}$pCp as described in Example 1, treated with the oxidation reaction of Example 2, and subjected to the biotinylation conditions of Example 3.

Sample 3. The 47 nucleotide capped in vitro transcript prepared as in Example 2 and labeled with $^{32}$pCp as described in Example 1.

Sample 4. The 47 nucleotide capped in vitro transcript prepared as in Example 2, labeled with $^{32}$pCp as described in Example 1, treated with the oxidation reaction of Example 2, and subjected to the biotinylation conditions of Example 3.

Samples 1 and 2 had indentical migration rates, demonstrating that the uncapped RNAs were not oxidized and biotinylated. Sample 3 migrated more slowly than Samples 1 and 2, while Sample 4 exhibited the slowest migration. The difference in migration of the RNAs in Samples 3 and 4 demonstrates that the capped RNAs were specifically biotinylated.

In some cases, mRNAs having intact 5' ends may be enriched by binding the molecule containing a reactive amine group to a suitable solid phase substrate such as the inside of the vessel containing the mRNAs, magnetic beads, chromatography matrices, or nylon or nitrocellulose membranes. For example, where the molecule having a reactive amine group is biotin, the solid phase substrate may be coupled to avidin or streptavidin. Alternatively, where the molecule having the reactive amine group is an antibody or receptor ligand, the solid phase substrate may be coupled to the cognate antigen or receptor. Finally, where the molecule having a reactive amine group comprises an oligonucleotide, the solid phase substrate may comprise a complementary oligonucleotide.

The mRNAs having intact 5' ends may be released from the solid phase following the enrichment procedure. For example, where the dialdehyde is coupled to biotin hydrazide and the solid phase comprises streptavidin, the mRNAs may be released from the solid phase by simply heating to 95 degrees Celsius in 2% SDS. In some methods, the molecule having a reactive amine group may also be cleaved from the mRNAs having intact 5' ends following enrichment. Example 5 describes the capture of biotinylated mRNAs with streptavidin coated beads and the release of the biotinylated mRNAs from the beads following enrichment.

EXAMPLE 5

Capture and Release of Biotinylated mRNAs using Streptividin Coated Beads

The streptavidin-coated magnetic beads were prepared according to the manufacturer's instructions (CPG Inc., USA). The biotinylated mRNAs were added to a hybridization buffer (1.5 M NaCl, pH 5-6). After incubating for 30 minutes, the unbound and nonbiotinylated material was removed. The beads were washed several times in water with 1% SDS. The beads obtained were incubated for 15 minutes at 95° C. in water containing 2% SDS.

Example 6 demonstrates the efficiency with which biotinylated mRNAs were recovered from the streptavidin coated beads.

EXAMPLE 6

Efficiency of Recovery of Biotinylated mRNAs

The efficiency of the recovery procedure was evaluated as follows. RNAs were labeled with $^{32}$pCp, oxidized, biotinylated and bound to streptavidin coated beads as described above. Subsequently, the bound RNAs were incubated for 5, 15 or 30 minutes at 95° C. in the presence of 2% SDS.

The products of the reaction were analyzed by electrophoresis on 12% polyacrylamide gels under denaturing conditions (7 M urea). The gels were subjected to autoradiography. During this manipulation, the hydrazone bonds were not reduced.

Increasing amounts of nucleic acids were recovered as incubation times in 2% SDS increased, demonstrating that biotinylated mRNAs were efficiently recovered.

In an alternative method for obtaining mRNAs having intact 5' ends, an oligonucleotide which has been derivatized to contain a reactive amine group is specifically coupled to mRNAs having an intact cap. Preferably, the 3' end of the mRNA is blocked prior to the step in which the aldehyde groups are joined to the derivatized oligonucleotide, as described above, so as to prevent the derivatized oligonucleotide from being joined to the 3' end of the mRNA. For example, pCp may be attached to the 3' end of the mRNA using T4 RNA ligase. However, as discussed above, blocking the 3' end of the mRNA is an optional step. Derivatized oligonucleotides may be prepared as described below in Example 7.

EXAMPLE 7

Derivatization of the Oligonucleotide

An oligonucleotide phosphorylated at its 3' end was converted to a 3' hydrazide in 3' by treatment with an aqueous solution of hydrazine or of dihydrazide of the formula $H_2N(R1)NH_2$ at about 1 to 3 M, and at pH 4.5, in the presence of a carbodiimide type agent soluble in water such as 1-ethyl-3-(3-dimethylaminopropyl)carbodiimide at a final concentration of 0.3 M at a temperature of 8° C. overnight.

The derivatized oligonucleotide was then separated from the other agents and products using a standard technique for isolating oligonucleotides.

As discussed above, the mRNAs to be enriched may be treated to eliminate the 3' OH groups which may be present thereon. This may be accomplished by enzymatic ligation of sequences lacking a 3' OH, such as pCp, as described above in Example 1. Alternatively, the 3' OH groups may be eliminated by alkaline hydrolysis as described in Example 8 below.

EXAMPLE 8

Alkaline Hydrolysis of mRNA

The mRNAs may be treated with alkaline hydrolysis as follows. In a total volume of 100 µl of 0.1N sodium hydroxide, 1.5 µg mRNA is incubated for 40 to 60 minutes at 4° C. The solution is neutralized with acetic acid and precipitated with ethanol.

Following the optional elimination of the 3' OH groups, the diol groups at the 5' ends of the mRNAs are oxidized as described below in Example 9.

EXAMPLE 9

Oxidation of Diols

Up to 1 OD unit of RNA was dissolved in 9 µl of buffer (0.1 M sodium acetate, pH 6-7 or water) and 3 µl of freshly prepared 0.1 M sodium periodate solution. The reaction was incubated for 1 h in the dark at 4° C. or room temperature. Following the incubation, the reaction was stopped by adding 4 µl of 10% ethylene glycol. Thereafter the mixture was incubated at room temperature for 15 minutes. After ethanol precipitation, the product was resuspended in 10 µl or more of water or appropriate buffer and dialyzed against water.

Following oxidation of the diol groups at the 5' ends of the mRNAs, the derivatized oligonucleotide was joined to the resulting aldehydes as described in Example 10.

EXAMPLE 10

Reaction of Aldehydes with Derivatized Oligonucleotides

The oxidized mRNA was dissolved in an acidic medium such as 50 µl of sodium acetate pH 4-6. 50 µl of a solution of the derivatized oligonucleotide was added such that an mRNA:derivatized oligonucleotide ratio of 1:20 was obtained and mixture was reduced with a borohydride. The mixture was allowed to incubate for 2 h at 37° C. or overnight (14 h) at 10° C. The mixture was ethanol precipitated, resuspended in 10 µl or more of water or appropriate buffer and dialyzed against distilled water. If desired, the resulting product may be analyzed using acrylamide gel electrophoresis, HPLC analysis, or other conventional techniques.

Following the attachment of the derivatized oligonucleotide to the mRNAs, a reverse transcription reaction may be performed as described in Example 11 below.

EXAMPLE 11

Reverse Transcription of mRNAs

An oligodeoxyribonucleotide was derivatized as follows. 3 OD units of an oligodeoxyribonucleotide of sequence ATCAAGAATTCGCACGAGACCATTA (SEQ ID NO:3) having 5'-OH and 3'-P ends were dissolved in 70 µl of a 1.5 M hydroxybenzotriazole solution, pH 5.3, prepared in dimethylformamide/water (75:25) containing 2 µg of 1-ethyl-3-(3-dimethylaminopropyl)carbodiimide. The mixture was incubated for 2 h 30 min at 22° C. The mixture was then precipitated twice in LiClO$_4$/acetone. The pellet was resuspended in 200 µl of 0.25 M hydrazine and incubated at 8° C. from 3 to 14 h. Following the hydrazine reaction, the mixture was precipitated twice in LiClO$_4$/acetone.

The messenger RNAs to be reverse transcribed were extracted from blocks of placenta having sides of 2 cm which had been stored at −80° C. The mRNA was extracted using conventional acidic phenol techniques. Oligo-dT chromatography was used to purify the mRNAs. The integrity of the mRNAs was checked by Northern-blotting.

The diol groups on 7 µg of the placental mRNAs were oxidized as described above in Example 9. The derivatized oligonucleotide was joined to the mRNAs as described in Example 10 above except that the precipitation step was replaced by an exclusion chromatography step to remove derivatized oligodeoxyribonucleotides which were not joined to mRNAs. Exclusion chromatography was performed as follows:

10 ml of AcA34 (BioSepra#230151) gel were equilibrated in 50 ml of a solution of 10 mM Tris pH 8.0, 300 mM NaCl, 1 mM EDTA, and 0.05% SDS. The mixture was allowed to sediment. The supernatant was eliminated and the gel was resuspended in 50 ml of buffer. This procedure was repeated 2 or 3 times.

A glass bead (diameter 3 mm) was introduced into a 2 ml disposable pipette (length 25 cm). The pipette was filled with the gel suspension until the height of the gel stabilized at 1 cm from the top of the pipette. The column was then equilibrated with 20 ml of equilibration buffer (10 mM Tris HCl pH 7.4, 20 mM NaCl).

10 µl of the mRNA which had been reacted with the derivatized oligonucleotide were mixed in 39 µl of 10 mM urea and 2 µl of blue-glycerol buffer, which had been prepared by dissolving 5 mg of bromophenol blue in 60% glycerol (v/v), and passing the mixture through a filter with a filter of diameter 0.45 µm.

The column was loaded. As soon as the sample had penetrated, equilibration buffer was added. 100 µl fractions were collected. Derivatized oligonucleotide which had not been attached to mRNA appeared in fraction 16 and later fractions. Fractions 3 to 15 were combined and precipitated with ethanol.

The mRNAs which had been reacted with the derivatized oligonucleotide were spotted on a nylon membrane and hybridized to a radioactive probe using conventional techniques. The radioactive probe used in these hybridizations was an oligodeoxyribonucleotide of sequence TAATGGTCTCGTGCGAATTCTTGAT (SEQ ID NO:4) which was anticomplementary to the derivatized oligonucleotide and was labeled at its 5' end with $^{32}$P. 1/10th of the mRNAs which had been reacted with the derivatized oligonucleotide was spotted in two spots on the membrane and the membrane was visualized by autoradiography after hybridization of the probe. A signal was observed, indicating that the derivatized oligonucleotide had been joined to the mRNA.

The remaining 9/10 of the mRNAs which had been reacted with the derivatized oligonucleotide was reverse transcribed as follows. A reverse transcription reaction was carried out with reverse transcriptase following the manufacturer's instructions. To prime the reaction, 50 pmol of nonamers with random sequence were used.

A portion of the resulting cDNA was spotted on a positively charged nylon membrane using conventional methods. The cDNAs were spotted on the membrane after the cDNA: RNA heteroduplexes had been subjected to an alkaline hydrolysis in order to eliminate the RNAs. An oligonucleotide having a sequence identical to that of the derivatized oligonucleotide was labeled at its 5' end with $^{32}$P and hybridized to the cDNA blots using conventional techniques. Single-stranded cDNAs resulting from the reverse transcription reaction were spotted on the membrane. As controls, the blot contained 1 pmol, 100 fmol, 50 fmol, 10 fmol and 1 fmol respectively of a control oligodeoxyribonucleotide of sequence identical to that of the derivatized oligonucleotide. The signal observed in the spots containing the cDNA indicated that approximately 15 fmol of the derivatized oligonucleotide had been reverse transcribed.

These results demonstrate that the reverse transcription can be performed through the cap and, in particular, that reverse transcriptase crosses the 5'-P-P-P-5' bond of the cap of eukaryotic messenger RNAs.

The single stranded cDNAs obtained after the above first strand synthesis were used as template for PCR reactions. Two types of reactions were carried out. First, specific amplification of the mRNAs for the alpha globin, dehydrogenase, pp15 and elongation factor E4 were carried out using the following pairs of oligodeoxyribonucleotide primers.

alpha-globin (SEQ ID NO:5)
GLO-S:   CCG ACA AGA CCA ACG TCA AGG CCG C

-continued

```
                                      (SEQ ID NO:6)
GLO-As:   TCA CCA GCA GGC AGT GGC TTA GGA G 3'
``` dehydrogenase

```
                                      (SEQ ID NO:7)
3 DH-S:   AGT GAT TCC TGC TAC TTT GGA TGG C (SEQ ID NO:8)
3 DH-As:  GCT TGG TCT TGT TCT GGA GTT TAG A
``` pp15

```
                                      (SEQ ID NO:9)
PP15-S:   TCC AGA ATG GGA GAC AAG CCA ATT T (SEQ ID NO:10)
PP15-As:  AGG GAG GAG GAA ACA GCG TGA GTC C
```

Elongation factor E4

```
                                      (SEQ ID NO:11)
EFA1-S:   ATG GGA AAG GAA AAG ACT CAT ATC A (SEQ ID NO:12)
EF1A-As:  AGC AGC AAC AAT CAG GAC AGC ACA G
```

Non specific amplifications were also carried out with the antisense (_As) oligodeoxyribonucleotides of the pairs described above and a primer chosen from the sequence of the derivatized oligodeoxyribonucleotide

```
                                      (SEQ ID NO:13)
         (ATCAAGAATTCGCACGAGACCATTA).
```

A 1.5% agarose gel containing the following samples corresponding to the PCR products of reverse transcription was stained with ethidium bromide (1/20th of the products of reverse transcription were used for each PCR reaction).

Sample 1: The products of a PCR reaction using the globin primers of SEQ ID NOs 5 and 6 in the presence of cDNA.

Sample 2: The products of a PCR reaction using the globin primers of SEQ ID NOs 5 and 6 in the the absence of added cDNA.

Sample 3: The products of a PCR reaction using the dehydrogenase primers of SEQ ID NOs 7 and 8 in the presence of cDNA.

Sample 4: The products of a PCR reaction using the dehydrogenase primers of SEQ ID NOs 7 and 8 in the absence of added cDNA.

Sample 5: The products of a PCR reaction using the pp15 primers of SEQ ID NOs 9 and 10 in the presence of cDNA.

Sample 6: The products of a PCR reaction using the pp15 primers of SEQ ID NOs 9 and 10 in the the absence of added cDNA.

Sample 7: The products of a PCR reaction using the EIE4 primers of SEQ ID NOs 11 and 12 in the presence of added cDNA.

Sample 8: The products of a PCR reaction using the EIE4 primers of SEQ ID NOs 11 and 12 in the absence of added cDNA.

In Samples 1, 3, 5 and 7, a band of the size expected for the PCR product was observed, indicating the presence of the corresponding sequence in the cDNA population.

PCR reactions were also carried out with the antisense oligonucleotides of the globin and dehydrogenase primers (SEQ ID NOs 6 and 8) and an oligonucleotide whose sequence corresponds to that of the derivatized oligonucleotide. The presence of PCR products of the expected size in the samples corresponding to samples 1 and 3 above indicated that the derivatized oligonucleotide had been incorporated.

The above examples summarize the chemical procedure for enriching mRNAs for those having intact 5' ends. Further detail regarding the chemical approaches for obtaining mRNAs having intact 5' ends are disclosed in International Application No. WO96/34981, published Nov. 7, 1996, which is incorporated herein by reference.

Strategies based on the above chemical modifications to the 5' cap structure may be utilized to generate cDNAs which have been selected to include the 5' ends of the mRNAs from which they are derived. In one version of such procedures, the 5' ends of the mRNAs are modified as described above. Thereafter, a reverse transcription reaction is conducted to extend a primer complementary to the mRNA to the 5' end of the mRNA. Single stranded RNAs are eliminated to obtain a population of cDNA/mRNA heteroduplexes in which the mRNA includes an intact 5' end. The resulting heteroduplexes may be captured on a solid phase coated with a molecule capable of interacting with the molecule used to derivatize the 5' end of the mRNA. Thereafter, the strands of the heteroduplexes are separated to recover single stranded first cDNA strands which include the 5' end of the mRNA. Second strand cDNA synthesis may then proceed using conventional techniques. For example, the procedures disclosed in WO 96/34981 or in Carninci, P. et al. High-Efficiency Full-Length cDNA Cloning by Biotinylated CAP Trapper. Genomics 37:327-336 (1996), the disclosures of which are incorporated herein by reference, may be employed to select cDNAs which include the sequence derived from the 5' end of the coding sequence of the mRNA.

Following ligation of the oligonucleotide tag to the 5' cap of the mRNA, a reverse transcription reaction is conducted to extend a primer complementary to the mRNA to the 5' end of the mRNA. Following elimination of the RNA component of the resulting heteroduplex using standard techniques, second strand cDNA synthesis is conducted with a primer complementary to the oligonucleotide tag.

FIG. 1 summarizes the above procedures for obtaining cDNAs which have been selected to include the 5' ends of the mRNAs from which they are derived.

B. Enzymatic Methods for Obtaining mRNAs having Intact 5' Ends

Other techniques for selecting cDNAs extending to the 5' end of the mRNA from which they are derived are fully enzymatic. Some versions of these techniques are disclosed in Dumas Milne Edwards J. B. (Doctoral Thesis of Paris VI University, Le clonage des ADNc complets: difficultes et perspectives nouvelles. Apports pour l'etude de la regulation de l'expression de la tryptophane hydroxylase de rat, 20 Dec. 1993, EP0 625572 and Kato et al. Construction of a Human Full-Length cDNA Bank. Gene 150:243-250 (1994), the disclosures of which are incorporated herein by reference.

Briefly, in such approaches, isolated mRNA is treated with alkaline phosphatase to remove the phosphate groups present on the 5' ends of uncapped incomplete mRNAs. Following this procedure, the cap present on full length mRNAs is enzymatically removed with a decapping enzyme such as T4 polynucleotide kinase or tobacco acid pyrophosphatase. An oligonucleotide, which may be either a DNA oligonucleotide or a DNA-RNA hybrid oligonucleotide having RNA at its 3' end, is then ligated to the phosphate present at the 5' end of the decapped mRNA using T4 RNA ligase. The oligonucleotide may include a restriction site to facilitate cloning of the cDNAs following their synthesis. Example 12 below describes one enzymatic method based on the doctoral thesis of Dumas.

EXAMPLE 12

Enzymatic Approach for Obtaining 5' ESTs

Twenty micrograms of PolyA+ RNA were dephosphorylated using Calf Intestinal Phosphatase (Biolabs). After a phenol chloroform extraction, the cap structure of mRNA was hydrolysed using the Tobacco Acid Pyrophosphatase (purified as described by Shinshi et al., Biochemistry 15: 2185-2190, 1976 and a hemi 5'DNA/RNA-3' oligonucleotide having an unphosphorylated 5' end, a stretch of adenosine ribophosphate at the 3' end, and an EcoRI site near the 5' end was ligated to the 5'P ends of mRNA using the T4 RNA ligase (Biolabs). Oligonucleotides suitable for use in this procedure are preferably 30-50 bases in length. Oligonucleotides having an unphosphorylated 5' end may be synthesized by adding a fluorochrome at the 5' end. The inclusion of a stretch of adenosine ribophosphates at the 3' end of the oligonucleotide increases ligation efficiency. It will be appreciated that the oligonucleotide may contain cloning sites other than EcoRI.

Following ligation of the oligonucleotide to the phosphate present at the 5' end of the decapped mRNA, first and second strand cDNA synthesis is carried out using conventional methods or those specified in EP0 625,572 and Kato et al. Construction of a Human Full-Length cDNA Bank. Gene 150:243-250 (1994), and Dumas Milne Edwards, supra, the disclosures of which are incorporated herein by reference. The resulting cDNA may then be ligated into vectors such as those disclosed in Kato et al. Construction of a Human Full-Length cDNA Bank. Gene 150:243-250 (1994) or other nucleic acid vectors known to those skilled in the art using techniques such as those described in Sambrook et al., Molecular Cloning: A Laboratory Manual 2d Ed., Cold Spring Harbor Laboratory Press, 1989, the disclosure of which is incorporated herein by reference.

II. Characterization of 5' ESTs

The above chemical and enzymatic approaches for enriching mRNAs having intact 5' ends were employed to obtain 5' ESTs. First, mRNAs were prepared as described in Example 13 below.

EXAMPLE 13

Preparation of mRNA

Total human RNAs or PolyA+ RNAs derived from 29 different tissues were respectively purchased from LABIMO and CLONTECH and used to generate 44 cDNA libraries as described below. The purchased RNA had been isolated from cells or tissues using acid guanidium thiocyanate-phenol-chloroform extraction (Chomczyniski, P and Sacchi, N., Analytical Biochemistry 162:156-159, 1987). PolyA+ RNA was isolated from total RNA (LABIMO) by two passes of oligodT chromatography, as described by Aviv and Leder (Aviv, H. and Leder, P., Proc. Natl. Acad. Sci. USA 69:1408-1412, 1972) in order to eliminate ribosomal RNA.

The quality and the integrity of the poly A+ were checked. Northern blots hybridized with a globin probe were used to confirm that the mRNAs were not degraded. Contamination of the PolyA+ mRNAs by ribosomal sequences was checked using RNAs blots and a probe derived from the sequence of the 28S RNA. Preparations of mRNAs with less than 5% of ribosomal RNAs were used in library construction. To avoid constructing libraries with RNAs contaminated by exogenous sequences (prokaryotic or fingal), the presence of bacterial 16S ribosomal sequences or of two highly expressed mRNAs was examined using PCR.

Following preparation of the mRNAs, the above described chemical and/or the enzymatic procedures for enriching mRNAs having intact 5' ends discussed above were employed to obtain 5' ESTs from various tissues. In both approaches an oligonucleotide tag was attached to the cap at the 5' ends of the mRNAs. The oligonucleotide tag had an EcoRI site therein to facilitate later cloning procedures.

Following attachment of the oligonucleotide tag to the mRNA by either the chemical or enzymatic methods, the integrity of the mRNA was examined by performing a Northern blot with 200-500 ng of mRNA using a probe complementary to the oligonucleotide tag.

EXAMPLE 14 cDNA Synthesis Using mRNA Templates Having Intact 5' Ends

For the mRNAs joined to oligonucleotide tags using both the chemical and enzymatic methods, first strand cDNA synthesis was performed with Superscript II (Gibco BRL) using random nonamers as primers. In order to protect internal EcoRI sites in the cDNA from digestion at later steps in the procedure, methylated dCTP was used for first strand synthesis. After removal of RNA by an alkaline hydrolysis, the first strand of cDNA was precipitated using isopropanol in order to eliminate residual primers.

For both the chemical and the enzymatic methods, synthesis of the second strand of the cDNA was conducted as follows. After removal of RNA by alkaline hydrolysis, the first strand of cDNA was precipitated using isopropanol in order to eliminate residual primers. The second strand of the cDNA was synthesized with Klenow using a primer corresponding to the 5' end of the ligated oligonucleotide described in Example 12. Preferably, the primer is 20-25 bases in length. Methylated dCTP was also used for second strand synthesis in order to protect internal EcoRI sites in the cDNA from digestion during the cloning process.

Following cDNA synthesis, the cDNAs were cloned into pBlueScript as described in Example 15 below.

EXAMPLE 15

Insertion of cDNAs into BlueScrit

Following second strand synthesis, the ends of the cDNA were blunted with T4 DNA polymerase (Biolabs) and the cDNA was digested with EcoRI. Since methylated dCTP was used during cDNA synthesis, the EcoRI site present in the tag was the only site which was hemi-methylated. Consequently, only the EcoRI site in the oligonucleotide tag was susceptible to EcoRI digestion. The cDNA was then size fractionated using exclusion chromatography (AcA, Biosepra). Fractions corresponding to cDNAs of more than 150 bp were pooled and ethanol precipitated. The cDNA was directionally cloned into the SmaI and EcoRI ends of the phagemid pBlueScript vector (Stratagene). The ligation mixture was electroporated into bacteria and propagated under appropriate antibiotic selection.

Clones containing the oligonucleotide tag attached were selected as described in Example 16 below.

EXAMPLE 16

Selection of Clones Having the Oligonucleotide Tag Attached Thereto

The plasmid DNAs containing 5' EST libraries made as described above were purified (Qiagen). A positive selection of the tagged clones was performed using the Gene Trapper kit (Gibco BRL). Briefly, in this selection procedure, the plasmid DNA was converted to single stranded DNA using the geneII product in combination with exonucleaseIII. The resulting single stranded DNA was then hybridized with a biotinylated oligonucleotide having a sequence corresponding to the 3' end of the oligonucleotide described in Example 12. Preferably, the primer has a length of 20-25 bases. Clones including a sequence complementary to the biotinylated oligonucleotide were captured by incubation with streptavidin coated magnetic beads followed by magnetic selection. After capture of the positive clones, the plasmid DNA was released from the magnetic beads and converted into double stranded DNA as recommended by the manufacture. The double stranded DNA was then electroporated into bacteria. The percentage of positive clones having the 5' tag oligonucleotide was estimated using dot blot analysis. Typically the percentage of positive clones was between 90 and 98%.

Following electroporation, the libraries were ordered in 384-microtiter plates (MTP). A copy of the MTP was stored for future needs. Then the libraries were transferred into 96 MTP and sequenced as described below.

EXAMPLE 17

Sequencing of Inserts in Selected Clones

Plasmid inserts were first amplified by PCR on PE 9600 thermocyclers (Perkin-Elmer), using standard SETA-A and SETA-B primers (Genset SA), AmpliTaqGold (Perkin-Elmer), dNTPs (Boehringer), buffer and cycling conditions as recommended by the Perkin-Elmer Corporation.

PCR products were then sequenced using automatic ABI Prism 377 sequencers (Perkin Elmer, Applied Biosystems Division, Foster City, Calif.). Sequencing reactions were performed using PE 9600 thermocyclers (Perkin Elmer) with standard dye-primer chemistry and ThermoSequenase (Amersham Life Science). The primers used were either T7 or 21M13 (available from Genset SA) as appropriate. The primers were labeled with the JOE, FAM, ROX and TAMRA dyes. The dNTPs and ddNTPs used in the sequencing reactions were purchased from Boehringer. Sequencing buffer, reagent concentrations and cycling conditions were as recommended by Amersham.

Following the sequencing reaction, the samples were precipitated with EtOH, resuspended in formamide loading buffer, and loaded on a standard 4% acrylamide gel. Electrophoresis was performed for 2.5 hours at 3000V on an ABI 377 sequencer, and the sequence data were collected and analyzed using the ABI Prism DNA Sequencing Analysis Software, version 2.1.2.

The sequence data from the 44 cDNA libraries made as described above were transferred to a proprietary database, where quality control and validation steps were performed. A proprietary base-caller ("Trace"), working using a Unix system automatically flagged suspect peaks, taking into account the shape of the peaks, the inter-peak resolution, and the noise level. The proprietary base-caller also performed an automatic trimming. Any stretch of 25 or fewer bases having more than 4 suspect peaks was considered unreliable and was discarded. Sequences corresponding to cloning vector or ligation oligonucleotides were automatically removed from the EST sequences. However, the resulting EST sequences may contain 1 to 5 bases belonging to the above mentioned sequences at their 5' end. If needed, these can easily be removed on a case by case basis.

Thereafter, the sequences were transferred to the proprietary NETGENE™ Database for further analysis as described below.

Following sequencing as described above, the sequences of the 5' ESTs were entered in a proprietary database called NETGENE™ for storage and manipulation. It will be appreciated by those skilled in the art that the data could be stored and manipulated on any medium which can be read and accessed by a computer. Computer readable media include magnetically readable media, optically readable media, or electronically readable media. For example, the computer readable media may be a hard disc, a floppy disc, a magnetic tape, CD-ROM, RAM, or ROM as well as other types of other media known to those skilled in the art.

In addition, the sequence data may be stored and manipulated in a variety of data processor programs in a variety of formats. For example, the sequence data may be stored as text in a word processing file, such as MicrosoftWORD or WORDPERFECT or as an ASCII file in a variety of database programs familiar to those of skill in the art, such as DB2, SYBASE, or ORACLE.

The computer readable media on which the sequence information is stored may be in a personal computer, a network, a server or other computer systems known to those skilled in the art. The computer or other system preferably includes the storage media described above, and a processor for accessing and manipulating the sequence data.

Once the sequence data has been stored it may be manipulated and searched to locate those stored sequences which contain a desired nucleic acid sequence or which encode a protein having a particular functional domain. For example, the stored sequence information may be compared to other known sequences to identify homologies, motifs implicated in biological function, or structural motifs.

Programs which may be used to search or compare the stored sequences include the MacPattern (EMBL), BLAST, and BLAST2 program series (NCBI), basic local alignment search tool programs for nucleotide (BLASTN) and peptide (BLASTX) comparisons (Altschul et al, J. Mol. Biol. 215: 403 (1990)) and FASTA (Pearson and Lipman, Proc. Natl. Acad. Sci. USA, 85: 2444 (1988)) and the programs listed below in the section relating to computer embodiments. The BLAST programs then extend the alignments on the basis of defined match and mismatch criteria.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

Before searching the cDNAs in the NETGENE™ database for sequence motifs of interest, cDNAs derived from mRNAs which were not of interest were identified and eliminated from further consideration as described in Example 18 below.

EXAMPLE 18

Elimination of Undesired Sequences from Further Consideration

5' ESTs in the NETGENE™ database which were derived from undesired sequences such as transfer RNAs, ribosomal RNAs, mitochondrial RNAs, procaryotic RNAs, fungal RNAs, Alu sequences, L1 sequences, or repeat sequences were identified using the FASTA and BLASTN programs with the parameters listed in Table I.

To eliminate 5' ESTs encoding tRNAs from further consideration, the 5' EST sequences were compared to the sequences of 1190 known tRNAs obtained from EMBL release 38, of which 100 were human. The comparison was performed using FASTA on both strands of the 5' ESTs. Sequences having more than 80% homology over more than 60 nucleotides were identified as tRNA. Of the 144,341 sequences screened, 26 were identified as tRNAs and eliminated from further consideration.

To eliminate 5' ESTs encoding rRNAs from further consideration, the 5' EST sequences were compared to the sequences of 2497 known rRNAs obtained from EMBL release 38, of which 73 were human. The comparison was performed using BLASTN on both strands of the 5' ESTs with the parameter S=108. Sequences having more than 80% homology over stretches longer than 40 nucleotides were identified as rRNAs. Of the 144,341 sequences screened, 3,312 were identified as rRNAs and eliminated from further consideration.

To eliminate 5' ESTs encoding mtRNAs from further consideration, the 5' EST sequences were compared to the sequences of the two known mitochondrial genomes for which the entire genomic sequences are available and all sequences transcribed from these mitochondrial genomes including tRNAs, rRNAs, and mRNAs for a total of 38 sequences. The comparison was performed using BLASTN on both strands of the 5' ESTs with the parameter S=108. Sequences having more than 80% homology over stretches longer than 40 nucleotides were identified as mtRNAs. Of the 144,341 sequences screened, 6,110 were identified as mtRNAs and eliminated from further consideration.

Sequences which might have resulted from exogenous contaminants were eliminated from further consideration by comparing the 5' EST sequences to release 46 of the EMBL bacterial and fingal divisions using BLASTN with the parameter S=144. All sequences having more than 90% homology over at least 40 nucleotides were identified as exogenous contaminants. Of the 42 cDNA libraries examined, the average percentages of procaryotic and fungal sequences contained therein were 0.2% and 0.5% respectively. Among these sequences, only one could be identified as a sequence specific to fungi. The others were either fungal or procaryotic sequences having homologies with vertebrate sequences or including repeat sequences which had not been masked during the electronic comparison.

In addition, the 5' ESTs were compared to 6093 Alu sequences and 1115 L1 sequences to mask 5' ESTs containing such repeat sequences from further consideration. 5' ESTs including THE and MER repeats, SSTR sequences or satellite, micro-satellite, or telomeric repeats were also eliminated from further consideration. On average, 11.5% of the sequences in the libraries contained repeat sequences. Of this 11.5%, 7% contained Alu repeats, 3.3% contained L1 repeats and the remaining 1.2% were derived from the other types of repetitive sequences which were screened. These percentages are consistent with those found in cDNA libraries prepared by other groups. For example, the cDNA libraries of Adams et al. contained between 0% and 7.4% Alu repeats depending on the source of the RNA which was used to prepare the cDNA library (Adams et al., Nature 377:174, 1996).

The sequences of those 5' ESTs remaining after the elimination of undesirable sequences were compared with the sequences of known human mRNAs to determine the accuracy of the sequencing procedures described above.

EXAMPLE 19

Measurement of Sequencing Accuracy by Comparison to Known Sequences

To further determine the accuracy of the sequencing procedure described above, the sequences of 5' ESTs derived from known sequences were identified and compared to the known sequences. First, a FASTA analysis with overhangs shorter than 5 bp on both ends was conducted on the 5' ESTs to identify those matching an entry in the public human mRNA database. The 6655 5' ESTs which matched a known human mRNA were then realigned with their cognate mRNA and dynamic programming was used to include substitutions, insertions, and deletions in the list of "errors" which would be recognized. Errors occurring in the last 10 bases of the 5' EST sequences were ignored to avoid the inclusion of spurious cloning sites in the analysis of sequencing accuracy.

This analysis revealed that the sequences incorporated in the NETGENE™ database had an accuracy of more than 99.5%.

To determine the efficiency with which the above selection procedures select cDNAs which include the 5' ends of their corresponding mRNAs, the following analysis was performed.

EXAMPLE 20

Determination of Efficiency of 5' EST Selection

To determine the efficiency at which the above selection procedures isolated cDNAs which included sequences close to the 5' end of the mRNAs from which they were derived, the sequences of the ends of the 5' ESTs which were derived from the elongation factor 1 subunit α and ferritin heavy chain genes were compared to the known cDNA sequences for these genes. Since the transcription start sites for the elongation factor 1 subunit α and ferritin heavy chain are well characterized, they may be used to determine the percentage of 5' ESTs derived from these genes which included the authentic transcription start sites.

For both genes, more than 95% of the cDNAs included sequences close to or upstream of the 5' end of the corresponding mRNAs.

To extend the analysis of the reliability of the procedures for isolating 5' ESTs from cDNAs in the NETGENE™ database, a similar analysis was conducted using a database composed of human mRNA sequences extracted from GenBank database release 97 for comparison. For those 5' ESTs derived from mRNAs included in the GeneBank database, more than 85% had their 5' ends close to the 5' ends of the known sequence. As some of the mRNA sequences available in the GenBank database are deduced from genomic sequences, a 5' end matching with these sequences will be counted as an internal match. Thus, the method used here underestimates the yield of cDNAs including the authentic 5' ends of their corresponding mRNAs.

The cDNA libraries made above included multiple 5' ESTs derived from the same mRNA. The sequences of such 5' ESTs were compared to one another and the longest 5' ESTs for each mRNA were identified. Overlapping cDNAs were assembled into continuous sequences (contigs). The resulting continuous sequences were then compared to public databases to gauge their similarity to known sequences, as described in Example 21 below.

EXAMPLE 21

Clustering of the 5' ESTs and Calculation of Novelty Indices for cDNA Libraries

For each sequenced cDNA library, the sequences were clustered by the 5' end. Each sequence in the library was compared to the others with BLASTN2 (direct strand, parameters S=107). ESTs with High Scoring Segment Pairs (HSPs) at least 25 bp long, having 95% identical bases and beginning closer than 10 bp from each EST 5' end were grouped. The longest sequence found in the cluster was used as representative of the cluster. A global clustering between libraries was then performed leading to the definition of super-contigs.

To assess the yield of new sequences within the cDNA libraries, a novelty rate (NR) was defined as: NR=100×(Number of new unique sequences found in the library/Total number of sequences from the library). Typically, novelty rating range between 10% and 41% depending on the tissue from which the cDNA library was obtained. For most of the libraries, the random sequencing of 5' EST libraries was pursued until the novelty rate reached 20%.

Following characterization as described above, the collection of 5' ESTs in NETGENE™ was screened to identify those 5' ESTs bearing potential signal sequences as described in Example 22 below.

EXAMPLE 22

Identification of Potential Signal Sequences in 5' ESTs

The 5' ESTs in the NETGENETm database (release 21 Jan. 1998) were screened to identify those having an uninterrupted open reading frame (ORF) longer than 45 nucleotides beginning with an ATG codon and extending to the end of the EST. Approximately half of the cDNA sequences in NETGENE™ contained such an ORF. The ORFs of these 5' ESTs were searched to identify potential signal motifs using slight modifications of the procedures disclosed in Von Heijne, G. A New Method for Predicting Signal Sequence Cleavage Sites. Nucleic Acids Res. 14:4683-4690 (1986), the disclosure of which is incorporated herein by reference. Those 5' EST sequences encoding a 15 amino acid long stretch with a score of at least 3.5 in the Von Heijne signal peptide identification matrix were considered to possess a signal sequence. Those 5' ESTs which matched a known human mRNA, EST, or 5' EST sequence were excluded from further analysis. The remaining cDNAs having signal sequences therein were included in a database called SIGNALTAG™.

To confirm the accuracy of the above method for identifying signal sequences, the analysis of Example 23 was performed.

EXAMPLE 23

Confirmation of Accuracy of Identification of Potential Signal Sequences in 5' ESTs The accuracy of the above procedure for identifying signal sequences encoding signal peptides was evaluated by applying the method to the 43 amino terminal amino acids of all human SwissProt proteins. The computed Von Heijne score for each protein was compared with the known characterization of the protein as being a secreted protein or a non-secreted protein. In this manner, the number of non-secreted proteins having a score higher than 3.5 (false positives) and the number of secreted proteins having a score lower than 3.5 (false negatives) could be calculated.

Figure 3:
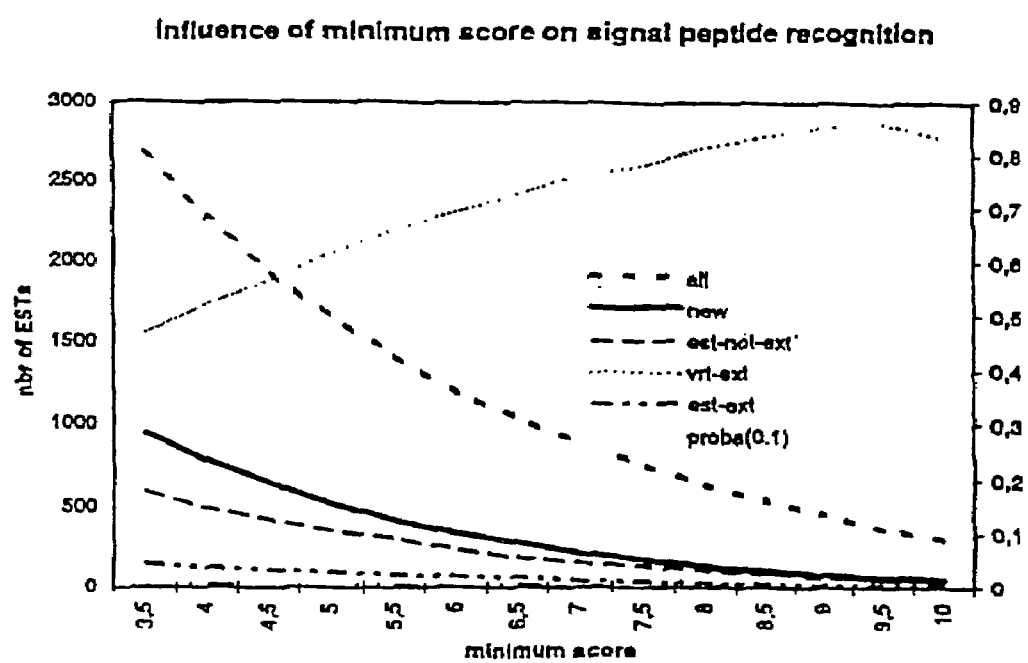
FIG. 3 shows the distribution of von Heijne scores for 5' ESTs in each of the categories described herein and the probability that these 5' ESTs encode a signal peptide.

Using the results of the above analysis, the probability that a peptide encoded by the 5' region of the mRNA is in fact a genuine signal peptide based on its Von Heijne's score was calculated based on either the assumption that 10% of human proteins are secreted or the assumption that 20% of human proteins are secreted. The results of this analysis are shown in FIGS. 2 and 3.

Using the above method of identifying secretory proteins, 5' ESTs for human glucagon, gamma interferon induced monokine precursor, secreted cyclophilin-like protein, human pleiotropin, and human biotinidase precursor all of which are polypeptides which are known to be secreted, were obtained. Thus, the above method successfully identified those 5' ESTs which encode a signal peptide.

To confirm that the signal peptide encoded by the 5' ESTs actually functions as a signal peptide, the signal sequences from the 5' ESTs may be cloned into a vector designed for the identification of signal peptides. Some signal peptide identification vectors are designed to confer the ability to grow in selective medium on host cells which have a signal sequence operably inserted into the vector. For example, to confirm that a 5' EST encodes a genuine signal peptide, the signal sequence of the 5' EST may be inserted upstream and in frame with a non-secreted form of the yeast invertase gene in signal peptide selection vectors such as those described in U.S. Pat. No. 5,536,637, the disclosure of which is incorporated herein by reference. Growth of host cells containing signal sequence selection vectors having the signal sequence from the 5' EST inserted therein confirms that the 5' EST encodes a genuine signal peptide.

Alternatively, the presence of a signal peptide may be confirmed by cloning the extended cDNAs obtained using the ESTs into expression vectors such as pXT1 (as described below), or by constructing promoter-signal sequence-reporter gene vectors which encode fusion proteins between the signal peptide and an assayable reporter protein. After introduction of these vectors into a suitable host cell, such as COS cells or NIH 3T3 cells, the growth medium may be harvested and analyzed for the presence of the secreted protein. The medium from these cells is compared to the medium from cells containing vectors lacking the signal sequence or extended cDNA insert to identify vectors which encode a functional signal peptide or an authentic secreted protein.

Those 5' ESTs which encoded a signal peptide, as determined by the method of Example 22 above, were further grouped into four categories based on their homology to known sequences. The categorization of the 5' ESTs is described in Example 24 below.

EXAMPLE 24

Categorization of 5' ESTs Encoding a Signal Peptide

Those 5' ESTs having a sequence not matching any known vertebrate sequence nor any publicly available EST sequence were designated "new." Of the sequences in the SIGNAL-TAG™ database, 395 of the 5' ESTs having a Von Heijne's score of at least 3.5 fell into this category.

Those 5' ESTs having a sequence not matching any vertebrate sequence but matching a publicly known EST were designated "EST-ext", provided that the known EST sequence was extended by at least 40 nucleotides in the 5' direction. Of the sequences in the SIGNALTAG™ database, 19 of the 5' ESTs having a Von Heijne's score of at least 3.5 fell into this category.

Those ESTs not matching any vertebrate sequence but matching a publicly known EST without extending the known EST by at least 40 nucleotides in the 5' direction were designated "EST-not-ext." Of the sequences in the SIGNAL-TAG™ database, 81 of the 5' ESTs having a Von Heijne's score of at least 3.5 fell into this category.

Those 5' ESTs matching a known vertebrate sequence were designated "vrt." Of the sequences in the SIGNALTAG™ database, 90 of the 5' ESTs having a Von Heijne's score of at least 3.5 fell into this category.

FIG. 4 shows the distribution of 5' ESTs in each category and the number of 5' ESTs in each category having a given minimum von Heijne's score.

Each of the 5' ESTs was categorized based on the tissue from which its corresponding mRNA was obtained, as described below in Example 25.

EXAMPLE 25

Categorization of Expression Patterns

FIG. 5 shows the tissues from which the mRNAs corresponding to the 5' ESTs in each of the above described categories were obtained.

Table II provides the sequence identification numbers of 5' EST sequences, the categories in which these sequences fall, and the von Heijne's score of the signal peptides which they encode. The 5' EST sequences and the amino acid sequences they encode are provided in the appended sequence listings. Table III provides the sequence ID numbers of the 5' ESTs and the sequences of the signal peptides which they encode. The sequences of the 5' ESTs and the polypeptides they encode are provided in the sequence listing appended hereto.

The sequences of DNA SEQ ID NOs: 38-1756 can readily be screened for any errors therein and any sequence ambiguities can be resolved by resequencing a fragment containing such errors or amibiguities on both strands. Such fragments may be obtained from the plasmids stored in the inventors' laboratory or can be isolated using the techniques described herein. Resolution of any such ambiguities or errors may be facilitated by using primers which hybridize to sequences located close to the ambiguous or erroneous sequences. For example, the primers may hybridize to sequences within 50-75 bases of the amibiguity or error. Upon resolution of an error or ambiguity, the corresponding corrections can be made in the protein sequences encoded by the DNA containing the error or ambiguity.

In addition to categorizing the 5' ESTs by the tissue from which the cDNA library in which they were first identified was obtained, the spatial and temporal expression patterns of the mRNAs corresponding to the 5' ESTs, as well as their expression levels, may be determined as described in Example 26 below. Characterization of the spatial and temporal expression patterns and expression levels of these mRNAs is useful for constructing expression vectors capable of producing a desired level of gene product in a desired spatial or temporal manner, as will be discussed in more detail below.

In addition, 5' ESTs whose corresponding mRNAs are associated with disease states may also be identified. For example, a particular disease may result from lack of expression, over expression, or under expression of an mRNA corresponding to a 5' EST. By comparing mRNA expression patterns and quantities in samples taken from healthy individuals with those from individuals suffering from a particular disease, 5' ESTs responsible for the disease may be identified.

EXAMPLE 26

Evaluation of Expression Levels and Patterns of mRNAs Corresponding to 5' ESTs Expression levels and patterns of mRNAs corresponding to 5' ESTs may be analyzed by solution hybridization with long probes as described in International Patent Application No. WO 97/05277, the entire contents of which are hereby incorporated by reference. Briefly, a 5' EST corresponding to a portion of a gene is inserted at a cloning site immediately downstream of a bacteriophage (T3, T7 or SP6) RNA polymerase promoter to produce antisense RNA. Preferably, the 5' EST has 100 or more nucleotides. The plasmid is linearized and transcribed in the presence of ribonucleotides comprising modified ribonucleotides (i.e. biotin-UTP and DIG-UTP). An excess of this doubly labeled RNA is hybridized in solution with mRNA isolated from cells or tissues of interest. The hybridizations are performed under standard stringent conditions (40-50° C. for 16 hours in an 80% formamide, 0.4 M NaCl buffer, pH 7-8). The unhybridized probe is removed by digestion with ribonucleases specific for single-stranded RNA (i.e. RNases CL3, T1, Phy M, U2 or A). The presence of the biotin-UTP modification enables capture of the hybrid on a microtitration plate coated with streptavidin. The presence of the DIG modification enables the hybrid to be detected and quantified by ELISA using an anti-DIG antibody coupled to alkaline phosphatase.

The 5' ESTs may also be tagged with nucleotide sequences for the serial analysis of gene expression (SAGE) as disclosed in UK Patent Application No. 2 305 241 A, the entire contents of which are incorporated by reference. In this method, cDNAs are prepared from a cell, tissue, organism or other source of nucleic acid for which it is desired to determine gene expression patterns. The resulting cDNAs are separated into two pools. The cDNAs in each pool are cleaved with a first restriction endonuclease, called an "anchoring enzyme," having a recognition site which is likely to be present at least once in most cDNAs. The fragments which contain the 5' or 3' most region of the cleaved cDNA are isolated by binding to a capture medium such as streptavidin coated beads. A first oligonucleotide linker having a first sequence for hybridization of an amplification primer and an internal restriction site for a "tagging endonuclease" is ligated to the digested cDNAs in the first pool. Digestion with the second endonuclease produces short "tag" fragments from the cDNAs.

A second oligonucleotide having a second sequence for hybridization of an amplification primer and an internal restriction site is ligated to the digested cDNAs in the second pool. The cDNA fragments in the second pool are also digested with the "tagging endonuclease" to generate short "tag" fragments derived from the cDNAs in the second pool. The "tags" resulting from digestion of the first and second pools with the anchoring enzyme and the tagging endonuclease are ligated to one another to produce "ditags." In some embodiments, the ditags are concatamerized to produce ligation products containing from 2 to 200 ditags. The tag sequences are then determined and compared to the sequences of the 5' ESTs to determine which 5' ESTs are expressed in the cell, tissue, organism, or other source of nucleic acids from which the tags were derived. In this way, the expression pattern of the 5' ESTs in the cell, tissue, organism, or other source of nucleic acids is obtained.

Quantitative analysis of gene expression may also be performed using arrays. As used herein, the term array means a one dimensional, two dimensional, or multidimensional arrangement of full length cDNAs, extended cDNAs, 5' ESTs or fragments thereof of sufficient length to permit specific detection of gene expression. Preferably, the fragments are at least 8, 10, 12, 15, 20, 23, 25, 28, 30, 35, 40, 50, 75, or 100 nucleotides in length.

For example, quantitative analysis of gene expression may be performed with full length cDNAs, extended cDNAs, 5' ESTs, or fragments thereof in a complementary DNA microarray as described by Schena et al. (*Science* 270:467-470, 1995; *Proc. Natl. Acad Sci. U.S.A.* 93:10614-10619, 1996). The full length cDNAs, extended cDNAs, 5' ESTs or fragments thereof are amplified by PCR and arrayed from 96-well microtiter plates onto silylated microscope slides using high-speed robotics. Printed arrays are incubated in a humid chamber to allow rehydration of the array elements and rinsed, once in 0.2% SDS for 1 min. twice in water for 1 min and once for 5 min in sodium borohydride solution. The arrays are submerged in water for 2 min at 95° C., transferred into 0.2% SDS for 1 min, rinsed twice with water, air dried and stored in the dark at 25° C.

Cell or tissue mRNA is isolated or commercially obtained and probes are prepared by a single round of reverse transcription. Probes are hybridized to 1 cm$^2$ microarrays under a 14×14 mm glass coverslip for 6-12 hours at 60° C. Arrays are washed for 5 min at 25° C. in low stringency wash buffer (1×SSC/0.2% SDS), then for 10 min at room temperature in high stringency wash buffer (0.1×SSC/0.2% SDS). Arrays are scanned in 0.1×SSC using a fluorescence laser scanning device fitted with a custom filter set. Accurate differential expression measurements are obtained by taking the average of the ratios of two independent hybridizations.

Quantitative analysis of the expression of genes may also be performed with full length cDNAs, extended cDNAs, 5' ESTs, or fragments thereof in complementary DNA arrays as described by Pietu et al. (Genome Research 6:492-503, 1996). The full length cDNAs, extended cDNAs, 5' ESTs or fragments thereof are PCR amplified and spotted on membranes. Then, mRNAs originating from various tissues or cells are labeled with radioactive nucleotides. After hybridization and washing in controlled conditions, the hybridized mRNAs are detected by phospho-imaging or autoradiography. Duplicate experiments are performed and a quantitative analysis of differentially expressed mRNAs is then performed.

Alternatively, expression analysis of the 5' ESTs can be done through high density nucleotide arrays as described by Lockhart et al. (Nature Biotechnology 14: 1675-1680, 1996) and Sosnowsky et al. (Proc. Natl. Acad. Sci. 94:1119-1123, 1997). Oligonucleotides of 15-50 nucleotides corresponding to sequences of the 5' ESTs, or cDNAs obtainable therewith, are synthesized directly on the chip (Lockhart et al., supra) or synthesized and then addressed to the chip (Sosnowski et al., supra). Preferably, the oligonucleotides are about 20 nucleotides in length.

cDNA probes labeled with an appropriate compound, such as biotin, digoxigenin or fluorescent dye, are synthesized from the appropriate mRNA population and then randomly fragmented to an average size of 50 to 100 nucleotides. The said probes are then hybridized to the chip. After washing as described in Lockhart et al., supra and application of different electric fields (Sosnowsky et al., Proc. Nail. Acad. Sctl. 94:1119-1123), the dyes or labeling compounds are detected and quantified. Duplicate hybridizations are performed. Comparative analysis of the intensity of the signal originating from cDNA probes on the same target oligonucleotide in different cDNA samples indicates a differential expression of the mRNA corresponding to the 5' EST, or cDNAs obtainable therewith, from which the oligonucleotide sequence has been designed.

III. Use of 5' ESTs to Clone cDNAs Containing the Authentic 5' End of the Corresponding mRNA as well as the Entire Protein Coding Sequence of the Corresponding mRNA and to Clone the Corresponding Genomic DNAs Once 5' ESTs which include the 5' end of the corresponding mRNAs have been selected using the procedures described above, they can be utilized to isolate cDNAs which include the entire coding sequence of the protein encoded by the corresponding mRNA, including the authentic translation start site, hereinafter referred to as "full length cDNAs". Example 27 below describes a general method for obtaining such cDNAs. Example 28 below describes the cloning and sequencing of a cDNA which includes the entire coding sequence and authentic 5' end of the corresponding mRNA for several secreted proteins.

The methods of Examples 27, 28, and 29 can also be used to obtain cDNAs which encode less than the entire coding sequence of the proteins encoded by the 5' ESTs. The cDNAs isolated using these methods encode at least 6, 8, 10, 12, 15, 18, 20, 23, 25, 28, 30, 35, 40, or 50 amino acids of the proteins encoded by the sequences of SEQ ID NOs: 38-1756. In a preferred embodiment, the cDNAs encode a full length protein sequence, which includes the protein coding sequences of SEQ ID NOs: 38-1756.

EXAMPLE 27

General Method for Using 5' ESTs to Clone and Sequence cDNAs which Include the Entire Coding Region and the Authentic 5' End of the Corresponding mRNA The following general method has been used to quickly and efficiently isolate cDNAs having the authentic 5' ends of their corresponding mRNAs as well as the full protein coding sequence. This method may be applied to obtain such cDNAs for any 5' EST in the NETGENE™ database, including those 5' ESTs encoding secreted proteins, as well as to obtain cDNAs which do not include the full coding sequence.

The method takes advantage of the known 5' sequence of the mRNA. An RT-PCR reaction is conducted on purified mRNA using a poly 14dT primer containing a 49 nucleotide sequence at its 5' end which permits the addition of a known sequence at the end of the cDNA which corresponds to the 3' end of the mRNA. For example, the primer may have the following sequence: 5'-ATC GTT GAG ACT CGT ACC AGC AGA GTC ACG AGA GAG ACT ACA CGG TAC TGG TTT TTT TTT TTT TTVN-3' (SEQ ID NO:14). Those skilled in the art will appreciate that other sequences may also be added to the poly dT sequence and used to prime the first strand synthesis. Using this primer and an enzyme having reverse transcriptase activity, such as SuperScriptII (Gibco BRL), a reverse transcript which is anchored at the 3' polyA site of the RNAs is generated.

After removal of the mRNA hybridized to the first cDNA strand by alkaline hydrolysis, the products of the alkaline hydrolysis and the residual poly dT primer are eliminated with an exclusion column such as an Aca34 (Biosepra) matrix, a mix of agarose and acrylamide.

A pair of nested primers on each end is designed based on the known 5' sequence from the 5' EST and the known 3' end resulting from the primer used in the first strand synthesis. Preferably, the nested primers at the 5' end are separated from one another by four to nine bases. The 5' primer sequences may be selected to have melting temperatures and specificities suitable for use in PCR using formulas or software well known to those skilled in the art. If it is desired to obtain cDNAs containing the full length protein coding sequence, including the authentic translation initiation site, primers comprising sequences upstream of the translation initiation site are used. Alternatively, the PCR product is sequenced and the coding region is determined.

Preferably, the nested primers at the 3' end are separated from one another by four to nine bases. For example, the nested 3' primers may have the following sequences: (5'-CCA GCA GAG TCA CGA GAG AGA CTA CAC GG-3' (SEQ ID NO:15), and 5'-CAC GAG AGA GAC TAC ACG GTA CTG G-3' (SEQ ID NO:16). These primers were selected because they have melting temperatures and specificities compatible with their use in PCR. However, those skilled in the art will appreciate that other sequences may also be used as primers.

The first PCR run of 25 cycles is performed using the Clontech Tth Polymerase Mix and the outer primer from each of the nested pairs. 1/2500 of the resulting PCR product is then used in a second 20 cycle PCR using the same enzyme and the liner primer from each of the nested pairs. Thereafter, the primers and nucleotides are removed. Depending on the position of the primer on the EST sequence, the PCR product obtained will or will not comprise the corresponding complete coding region. If a PCR product contains the complete coding sequence, it is cloned into an appropriate vector and sequenced. Alternatively, the full coding sequence can be determined by directly sequencing the PCR product. If needed, the complete coding sequence can be assembled from several partial sequences determined directly from the PCR products. Sequencing is performed using Die Terminator approach using the AmpliTaqFS kit available from Perkin Elmer. If a PCR product does not contain the complete coding sequence, a cDNA product containing the full length protein coding sequence is preferably obtained by determining the coding sequence and performing RT-PCRs with primers spanning the coding region. The PCR product is cloned in an appropriate vector.

For example, the cDNAs can be cloned into pED6dpc2 (DiscoverEase, Genetics Institute, Cambridge, Mass.) as follows. pED6dpc2 vector DNA is prepared with blunt ends by performing an EcoRi digestion followed by a fill in reaction. The blunt ended vector is dephosphorylated. After removal of PCR primers and ethanol precipitation, the PCR product containing the full length protein coding sequence or extended cDNA obtained as described above is phosphorylated with kinase, and the kinase is removed by phenol-Sevag extraction and precipitation. The double stranded cDNA is then ligated to the vector. The resulting expression plasmid is introduced into appropriate host cells.

Since the PCR products obtained as described above are cloned as blunt ended molecules, 4 to 10 clones for each PCR product are ordered in microtiter plates. To determine the orientation of each clone, a PCR reaction is carried out using a first primer located in the vector close to the portion of the cDNA corresponding to the 5' end of the mRNA which has been cloned into the EcoRI site and a second primer located in the portion of the extended cDNA corresponding to the 3' end of the mRNA. Clones in which the start codon of the cDNA is operably linked to the promoter in the vector so as to permit expression of the protein encoded by the extended cDNA are conserved and sequenced. In addition to sequencing the cDNA inserts in the vectors, approximately 50 bp of vector sequence on each side of the cDNA insert is sequenced.

In order to sequence long fragments primer walling is performed using automated computer software such as ASMG (Sutton, G. G. et al. TIGR Assembler: A New Tool for Assembling Large Shotgun Sequencing Projects. Genome Science and Technology 1: 9-19 (1995)) to construct contigs and software such as OSP (Illier, L and Green, P. OSP: A Computer Program for Choosing PCR and DNA sequencing Primers. PCR Methods Appl. 1(2): 124-128 (1991)to choose primers.

Preferably, primer walking is performed until full length cDNAs (i.e. extended cDNAs which include the coding sequence for the signal peptide, the coding sequence for the mature protein, and a stop codon) are obtained. The sequencing of clones is continued until the inserts comprising the full coding sequence have been completely sequenced.

The structural (polyA tail, polyadenyaltion signal) and functional (ORF, signal peptide) features of the sequences are then determined. A polyA tail is defined as an 11 A homopolymeric stretch with at most one alternative base within it. The polyA tail search is restricted to the end of the sequence. The search is limited to stretches of 11 consecutive A's because sequencing reactions are often not readable after such a polyA stretch.

To search for a poly adenylation signal, the polyA tail is first clipped from the full-length sequence. The 50 bp preceding the polyA tail are then searched for consensus polyA signals. First, the 50 bp preceding the polyA tail are searched for the consensus polyA signal AAUAAA. If that consensus site is not detected, the 50 bp preceding the polyA tail are searched for a second alternative polyA signal, AUUAAA. (Sheets, M. D., Ogg, S. C. and Wickens, M. P. (1990) N.A.R. 18, 5799-5805).

When Northern blot data are available, the size of the mRNA detected for a given PCR product is used to finally assess that the sequence is complete. Sequences which do not fulfill the above criteria are discarded and will undergo a new isolation procedure.

The 3 upper strand frames are searched for open reading frames (ORFs). They are defined as the maximum length fragments beginning with an ATG and ending with a stop codon. Only ORFs encoding at least 20 amino acids are considered. Each ORF found is then scanned for the presence of a signal peptide in the first 50 amino-acids or, where appropriate, within shorter regions down to the minimum 20 amino acids in the ORF, using the matrix method of von Heijne, (1986) N.A.R. 4683-4690, the disclosure of which is incorporated herein by reference, as described above. Finally, the conservation of the signal peptide and of the ORF detected from the 5'-tag sequence corresponding to the studied extended cDNA is examined. It should be noted that in some cases, extended cDNA sequences lacking a poly A signal but containing an ORF ending before the poly A tail may also be used to determine the full coding sequence.

Extended cDNAs prepared as described above may be manipulated to obtain nucleic acids which include desired portions of the extended cDNA. Conventional techniques such as subcloning, PCR, or in vitro oligonucleotide synthesis may be employed to obtain nucleic acids containing the desired portions of the extended cDNAs. For example, nucleic acids which include only the full coding sequences (i.e. the sequences encoding the signal peptide and the mature protein remaining after the signal peptide is cleaved off) may be obtained using conventional techniques. Alternatively, conventional techniques may be applied to obtain nucleic acids which contain only the coding sequences for the mature protein remaining after the signal peptide is cleaved off or nucleic acids which contain only the coding sequences for the signal peptides.

Similarly, nucleic acids containing any other desired portion of the coding sequences for the secreted protein may be obtained. For example, the nucleic acid may contain at least 8, 10, 12, 15, 20, 23, 25, 28, 30, 35, 40, 50, 75, 100, 200, 300, 500, or 1000 consecutive bases of an extended cDNA such as one of the extended cDNAs described below.

Once an extended cDNA has been obtained, it can be sequenced to determine the amino acid sequence it encodes. Once the encoded amino acid sequence has been determined, one can create and identify any of the many conceivable cDNAs that will encode that protein by simply using the known genetic code. For example, allelic variants or other homologous nucleic acids can be identified as described below. Alternatively, nucleic acids encoding the desired amino acid sequence can be synthesized in vitro.

In a preferred embodiment, the coding sequence may be selected using the known codon or codon pair preferences for the host organism in which the cDNA is to be expressed.

cDNAs which include the entire coding sequence of secreted proteins may be obtained as described in Example 28 below.

Once a cDNA has been obtained, it can be sequenced to determine the amino acid sequence it encodes. Once the encoded amino acid sequence has been determined, one can create and identify any of the many conceivable cDNAs that will encode that protein by simply using the known genetic code.

In a preferred embodiment, the coding sequence may be selected using the known codon or codon pair preferences for the host organism in which the cDNA is to be expressed.

EXAMPLE 28

Cloning and Sequencing of a Full Length cDNA Encoding a Secreted Protein

The procedure described in Example 27 above was used to obtain full length cDNAs. Using this approach, the full length cDNA of SEQ ID NO:17 (internal identification number 48-19-3-G1-FL1) was obtained. This cDNA falls into the "EST-ext" category described above and encodes the signal peptide MKKVLLLITAILAVAVG (SEQ ID NO: 18) having a von Heijne score of 8.2.

The full length cDNA of SEQ ID NO:19 (internal identification number 58-34-2-E7-FL2) was also obtained using this procedure. This cDNA falls into the "EST-ext" category described above and encodes the signal peptide MWWFQQGLSFLPSALVIWTSA (SEQ ID NO:20) having a von Heijne score of 5.5.

Another full length cDNA obtained using the procedure described above has the sequence of SEQ ID NO:21 (internal identification number 51-27-E8-FL1). This cDNA, falls into the "EST-ext" category described above and encodes the signal peptide MVLTTLPSANSANSPVNMPTTGPNSLSYASSALSPCLT (SEQ ID NO:22) having a von Heijne score of 5.9.

The above procedure was also used to obtain a full length cDNA having the sequence of SEQ ID NO:23 (internal identification number 76-4-1-G5-FL1). This cDNA falls into the "EST-ext" category described above and encodes the signal peptide ILSTVTALTFAXA (SEQ ID NO:24) having a von Heijne score of 5.5.

The full length cDNA of SEQ ID NO:25 (internal identification number 51-3-3-B10-FL3) was also obtained using this procedure. This cDNA falls into the "new" category described above and encodes a signal peptide LVLTLCTLPLAVA (SEQ ID NO:26) having a von Heijne score of 10.1.

The full length cDNA of SEQ ID NO:27 (internal identification number 58-35-2-F10-FL2) was also obtained using this procedure. This cDNA falls into the "new" category described above and encodes a signal peptide LWLLFFLVTAIHA (SEQ ID NO:28) having a von Heijne score of 10.7.

Bacterial clones containing plasmids containing the full length cDNAs described above are presently stored in the inventor's laboratories under the internal identification numbers provided above. The inserts may be recovered from the stored materials by growing an aliquot of the appropriate bacterial clone in the appropriate medium. The plasmid DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the cDNA insertion. The PCR product which corresponds to the cDNA can then be manipulated using standard cloning techniques familiar to those skilled in the art.

In addition to PCR based methods for obtaining cDNAs which include the authentic 5' end of the corresponding mRNA as well as the full protein coding sequence of the corresponding mRNA, traditional hybridization based methods may also be employed. These methods may also be used to obtain the genomic DNAs which encode the mRNAs from which the 5' ESTs were derived. Example 29 below provides an example of such methods.

The polypeptides encoded by the cDNAs obtained as described above may be screened for the presence of known structural or functional motifs or for the presence of signatures, small amino acid sequences which are well conserved amongst the members of a protein family. The conserved regions have been used to derive consensus patterns or matrices included in the PROSITE data bank, in particular in the file prosite.dat (Release 13.0 of November 1995, located at http://expasy.hcuge.ch/sprot/prosite.html. Prosite_convert and prosite_scan programs (http://ulrec3.unil.ch/ftpserveur/prosite_scan) may be used to find signatures on the cDNAs.

For each pattern obtained with the prosite_convert program from the prosite.dat file, the accuracy of the detection on a new protein sequence may be tested by evaluating the frequency of irrelevant hits on the population of human secreted proteins included in the data bank SWISSPROT. The ratio between the number of hits on shuffled proteins (with a window size of 20 amino acids) and the number of hits on native (unshuffled) proteins may be used as an index. Every pattern for which the ratio is greater than 20% (one hit on shuffled proteins for 5 hits on native proteins) may be skipped during the search with prosite_scan. A program which may be used to shuffle protein sequences (db_shuffled) and a program which may be used to determine the statistics for each pattern in the protein data banks (prosite_statistics) are available on the ftp site http://ulrec3. unil.ch/ftpserveur/prosite_scan.

The cDNAs may be further categorized based on the homology to known sequences. Genbank release #104, division ESTs, and Geneseq release #28 may be used to scan the cDNAs using Blast. For each cDNA, the covering rate of the sequence by another sequence maybe determined as follows. The length in nucleotides of the matching segment is calculated (even when gaps are present) and divided by the length in nucleotides of the cDNA sequence. When more than one covering rate is obtained for a given cDNA, the higher covering rate may be used to classify the extended cDNA.

EXAMPLE 29

Methods for Obtaining cDNAs which Include the Entire Coding Region and the Authentic 5' End of the Corresponding mRNA A full length cDNA library can be made using the strategies described in Examples 13, 14, 15, and 16 above by replacing the random nonamer used in Example 14 with an oligo-dT primer. For instance, the oligonucleotide sequence of SEQ ID NO:14 may be used.

Alternatively, a cDNA library or genomic DNA library may be obtained from a commercial source or made using techniques familiar to those skilled in the art. The cDNA library or genomic DNA library is hybridized to a detectable probe comprising at least 8, 10, 12, 15, 20, 23, 25, 28, 30, 35, 40, 50, 75, 100, 200, 300, or 500 consecutive nucleotides from the 5' EST using conventional techniques. In some embodiments, the probe comprises more than 40 nucleotides from the 5' EST.

Techniques for identifying cDNA clones in a cDNA library which hybridize to a given probe sequence are disclosed in Sambrook et al., Molecular Cloning: A Laboratory Manual 2d Ed., Cold Spring Harbor Laboratory Press, 1989, the disclosure of which is incorporated herein by reference. The same techniques may be used to isolate genomic DNAs.

Briefly, cDNA or genomic DNA clones which hybridize to the detectable probe are identified and isolated for further manipulation as follows. A probe comprising at least 8, 10, 12, 15, 20, 23, 25, 28, 30, 35, 40, 50, 75, 100, 200, 300, 500, or more than 500 consecutive nucleotides from the 5' EST is labeled with a detectable label such as a radioisotope or a fluorescent molecule.

Techniques for labeling the probe are well known and include phosphorylation with polynucleotide kinase, nick translation, in vitro transcription, and non-radioactive techniques. The cDNAs or genomic DNAs in the library are transferred to a nitrocellulose or nylon filter and denatured. After incubation of the filter with a blocking solution, the filter is contacted with the labeled probe and incubated for a sufficient amount of time for the probe to hybridize to cDNAs or genomic DNAs containing a sequence capable of hybridizing to the probe.

By varying the stringency of the hybridization conditions used to identify cDNAs or genomic DNAs which hybridize to the detectable probe, cDNAS having different levels of homology to the probe can be identified and isolated. To identify cDNAs or genomic DNAs having a high degree of homology to the probe sequence, the melting temperature of the probe may be calculated using the following formulas:

For probes between 14 and 70 nucleotides in length the melting temperature (Tm) is calculated using the formula: Tm=81.5+16.6(log [Na+])+0.41 (fraction G+C)−(600/N) where N is the length of the probe.

If the hybridization is carried out in a solution containing formamide, the melting temperature may be calculated using the equation Tm=81.5+16.6(log [Na+])+0.41 (fraction G+C)−(0.63% formamide)−(600/N) where N is the length of the probe.

Prehybridization may be carried out in 6×SSC, 5× Denhardt's reagent, 0.5% SDS, 100 µg denatured fragmented salmon sperm DNA or 6×SSC, 5× Denhardt's reagent, 0.5% SDS, 100 µg denatured fragmented salmon sperm DNA, 50% formamide. The formulas for SSC and Denhardt's solutions are listed in Sambrook et al., supra.

Hybridization is conducted by adding the detectable probe to the prehybridization solutions listed above. Where the probe comprised double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the Tm. For shorter probes, such as oligonucleotide probes, the hybridization may be conducted at 15-25° C. below the Tm. Preferably, for hybridizations in 6×SSC, the hybridization is conducted at approximately 68° C. Preferably, for hybridizations in 50% formamide containing solutions, the hybridization is conducted at approximately 42° C.

All of the foregoing hybridizations would be considered to be under "stringent" conditions.

Following hybridization, the filter is washed in 2×SSC, 0.1% SDS at room temperature for 15 minutes. The filter is then washed with 0.1×SSC, 0.5% SDS at room temperature for 30 minutes to 1 hour. Thereafter, the solution is washed at the hybridization temperature in 0.1×SSC, 0.5% SDS. A final wash is conducted in 0.1×SSC at room temperature.

cDNAs or genomic DNAs which have hybridized to the probe are identified by autoradiography or other conventional techniques.

The above procedure may be modified to identify cDNAs or genomic DNAs having decreasing levels of homology to the probe sequence. For example, to obtain cDNAs or genomic DNAs of decreasing homology to the detectable probe, less stringent conditions may be used. For example, the hybridization temperature may be decreased in increments of 5° C. from 68° C. to 42° C. in a hybridization buffer having a Na+ concentration of approximately 1M. Following hybridization, the filter may be washed with 2×SSC, 0.5% SDS at the temperature of hybridization. These conditions are considered to be "moderate" conditions above 50° C. and "low" conditions below 50° C.

Alternatively, the hybridization may be carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide.

cDNAs or genomic DNAs which have hybridized to the probe are identified by autoradiography.

In some embodiments, the methods above are used to identify and isolate inserts in genomic DNA libraries which contain sequences encoding a secreted polypeptide or a portion thereof. For example, the library may comprise genomic fragments generated by the U.S. Human Genome Projects or other public and private genome sequencing projects. Clones in the library which hybridize to detectable probes comprising the polynucleotides of the present invention are identified and their inserts, or portions thereof, are isolated using conventional methods such as restriction digestion or amplification reactions. The genomic inserts or portions thereof, are then cloned into a desired vector, such as an expression vector.

Alternatively, cDNAs may be prepared by obtaining mRNA from the tissue, cell, or organism of interest using mRNA preparation procedures utilizing poly A selection procedures or other techniques known to those skilled in the art. A first primer capable of hybridizing to the poly A tail of the mRNA is hybridized to the mRNA and a reverse transcription reaction is performed to generate a first cDNA strand.

The first cDNA strand is hybridized to a second primer containing at least 10, 15, 20, 25, 30, 35 or 40 consecutive nucleotides of the sequences of SEQ ID NOs 38-1756. In some embodiments, the primer comprises more than 40 nucleotides from the sequences of SEQ ID NOs 38-1756. If it is desired to obtain cDNAs containing the full protein coding sequence, including the authentic translation initiation site, the second primer used contains sequences located upstream of the translation initiation site. The second primer is extended to generate a second cDNA strand complementary to the first cDNA strand. Alternatively, RTPCR may be performed as described above using primers from both ends of the cDNA to be obtained.

cDNAs containing 5' fragments of the mRNA may be prepared by contacting an mRNA comprising the sequences of SEQ ID NOs: 38-1756 with a primer comprising at least 10, 15, 20, 25, 30, 35 or 40 consecutive nucleotides of the sequences complementary to SEQ ID NOs: 38-1756, hybridizing the primer to the mRNAs, and reverse transcribing the hybridized primer to make a first cDNA strand from the mRNAs.

Thereafter, a second cDNA strand complementary to the first cDNA strand is synthesized. The second cDNA strand may be made by hybridizing a primer complementary to sequences in the first cDNA strand to the first cDNA strand and extending the primer to generate the second cDNA strand.

The double stranded cDNAs made using the methods above are isolated and cloned. The cDNAs may be cloned into vectors such as plasmids or viral vectors capable of replicating in an appropriate host cell. For example, the host cell may be a bacterial, mammalian, avian, or insect cell.

Techniques for isolating mRNA, reverse transcribing a primer hybridized to mRNA to generate a first cDNA strand, extending a primer to make a second cDNA strand complementary to the first cDNA strand, isolating the double stranded cDNA and cloning the double stranded cDNA are well known to those skilled in the art and are described in Current Protocols in Molecular Biology, John Wiley 503 Sons, Inc. 1997 and Sambrook et al. Molecular Cloning: A Laboratory Manual, Second Edition, Cold Spring Harbor Laboratory Press, 1989, the entire disclosures of which are incorporated herein by reference.

Alternatively, kits for obtaining full length cDNAs, such as the GeneTrapper (Cat. No. 10356-020, Gibco, BRL), may be used for obtaining full length cDNAs. In this approach, cDNA inserts are cloned into double stranded phagemids. The cDNA library in the double stranded phagemids is then rendered single stranded by treatment with an endonuclease, such as the Gene II product of the phage F1, and Exonuclease III as described in the manual accompanying the GeneTrapper kit, which is incorporated herein by reference. A biotinylated oligonucleotide comprising the sequence of a 5' EST, or a fragment containing at least 10, 15, 20, 25, 30, 35 or 40 nucleotides thereof, is hybridized to the single stranded phagemids. In some procedures, the fragment may comprise more than 40 consecutive nucleotides from the 5' EST.

Hybrids between the biotinylated oligonucleotide and phagemids having inserts containing the 5' EST sequence are isolated by incubating the hybrids with streptavidin coated paramagnetic beads and retrieving the beads with a magnet. Thereafter, the resulting phagemids containing the 5' EST sequence are released from the beads and converted into double stranded DNA using a primer specific for the 5' EST sequence. The resulting double stranded DNA is transformed into bacteria. cDNAs containing the 5' EST sequence are identified by colony PCR or colony hybridization.

A plurality of cDNAs containing full length protein coding sequences, or sequences encoding only the mature protein remaining after the signal peptide is cleaved, may be provided as selected cDNA libraries for subsequent evaluation of the encoded proteins or use in diagnostic assays as described below.

IV. Expression of Proteins Encoded by cDNAs Isolated Using 5' ESTs cDNAs containing the full protein coding sequences of their corresponding mRNAs, or portions thereof, such as cDNAs encoding the mature protein remaining after the signal peptide is cleaved, may be used to express the secreted proteins, or portions thereof, which they encode as described in Example 30 below. If desired, the cDNAs may contain the sequences encoding the signal peptide to facilitate secretion of the expressed protein. It will be appreciated that a plurality of cDNAs containing the full protein coding sequences may be simultaneously cloned into expression vectors to create an expression library for analysis of the encoded proteins as described below.

EXAMPLE 30

Expression of the Proteins Encoded by the Genes Corresponding to the 5' ESTs

To express the proteins encoded by the genes corresponding to 5' ESTs (or portions thereof), full length cDNAs containing the entire protein coding region or extended cDNAs containing sequences adjacent to the 5' ESTs (or portions thereof) are obtained as described in Examples 27-29. If desired, the cDNAs may contain the sequences encoding the signal peptide to facilitate secretion of the expressed protein. The cDNAs may also contain sequences upstream of the sequences encoding the signal peptide, such as sequences which regulate expression levels or sequences which confer tissue specific expression.

The cDNA is operably linked to a promoter in an expression vector using conventional cloning technology. The expression vector may be any of the mammalian, yeast, insect or bacterial expression systems known in the art. Commercially available vectors and expression systems are available from a variety of suppliers including Genetics Institute (Cambridge, Mass.), Stratagene (La Jolla, Calif.), Promega (Madison, Wis.), and Invitrogen (San Diego, Calif.). If desired, to enhance expression and facilitate proper protein folding, the codon context and codon pairing of the sequence may be optimized for the particular expression organism in which the expression vector is introduced, as explained by Hatfield, et al., U.S. Pat. No. 5,082,767, incorporated herein by this reference.

The cDNA cloned into the expression vector may encode the entire protein (i.e. the signal peptide and the mature protein), the mature protein (i.e. the protein created by cleaving the signal peptide off), only the signal peptide or any other portion thereof.

The following is provided as one exemplary method to express the proteins encoded by the cDNAs corresponding to the 5' ESTs. First, the methionine initiation codon for the gene and the poly A signal of the gene are identified. If the nucleic acid encoding the polypeptide to be expressed lacks a methionine to serve as the intitiation site, an intiating methionine can be introduced next to the first codon of the nucleic acid using conventional techniques. Similarly, if the cDNA lacks a poly A signal, this sequence can be added to the construct by, for example, splicing out the Poly A sequence from pSG5 (Stratagene) using BglI and SalI restriction endonuclease enzymes and incorporating it into the mammalian expression vector pXT1 (Stratagene). pXT1 contains the LTRs and a portion of the gag gene from Moloney Murine Leukemia Virus. The position of the LTRs in the construct allow efficient stable transfection. The vector includes the Herpes Simplex Thymidine Kinase promoter and the selectable neomycin gene. The cDNA or portion thereof encoding the polpypeptide to be expressed is obtained by PCR from the bacterial vector using oligonucleotide primers complementary to the cDNA or portion thereof and containing restriction endonuclease sequences for Pst I incorporated into the 5' primer and BglII at the 5' end of the corresponding cDNA 3' primer, taking care to ensure that the cDNA is positioned in frame with the poly A signal. The purified fragment obtained from the resulting PCR reaction is digested with PstI, blunt ended with an exonuclease, digested with BglII, purified and ligated to pXT1, now containing a poly A signal and digested with BglII.

The ligated product is transfected into mouse NIH 3T3 cells using Lipofectin (Life Technologies, Inc., Grand Island, N.Y.) under conditions outlined in the product specification. Positive transfectants are selected after growing the transfected cells in 600 ug/ml G418 (Sigma, St. Louis, Mo.). Preferably the expressed protein is released into the culture medium, thereby facilitating purification.

Alternatively, the extended cDNAs may be cloned into pED6dpc2 as described above. The resulting pED6dpc2 constructs may be transfected into a suitable host cell, such as COS 1 cells. Methotrexate resistant cells are selected and expanded. Preferably, the protein expressed from the extended cDNA is released into the culture medium thereby facilitating purification.

Proteins in the culture medium are separated by gel electrophoresis. If desired, the proteins may be ammonium sulfate precipitated or separated based on size or charge prior to electrophoresis.

As a control, the expression vector lacking a cDNA insert is introduced into host cells or organisms and the proteins in the medium are harvested. The secreted proteins present in the medium are detected using techniques such as Coomassie or silver staining or using antibodies against the protein encoded by the cDNA. Coomassie and silver staining techniques are familiar to those skilled in the art.

Antibodies capable of specifically recognizing the protein of interest may be generated using synthetic 15-mer peptides having a sequence encoded by the appropriate 5' EST, full length cDNA, extended cDNA or portion thereof. The synthetic peptides are injected into mice to generate antibody to the polypeptide encoded by the cDNA.

Secreted proteins from the host cells or organisms containing an expression vector which contains the cDNA derived from a 5' EST or a portion thereof are compared to those from the control cells or organism. The presence of a band in the medium from the cells containing the expression vector which is absent in the medium from the control cells indicates that the cDNA encodes a secreted protein. Generally, the band corresponding to the protein encoded by the cDNA will have a mobility near that expected based on the number of amino acids in the open reading frame of the cDNA. However, the band may have a mobility different than that expected as a result of modifications such as glycosylation, ubiquitination, or enzymatic cleavage.

Alternatively, if the protein expressed from the above expression vectors does not contain sequences directing its secretion, the proteins expressed from host cells containing an expression vector containing an insert encoding a secreted protein or portion thereof can be compared to the proteins expressed in host cells containing the expression vector without an insert. The presence of a band in samples from cells containing the expression vector with an insert which is absent in samples from cells containing the expression vector without an insert indicates that the desired protein or portion thereof is being expressed. Generally, the band will have the mobility expected for the secreted protein or portion thereof. However, the band may have a mobility different than that expected as a result of modifications such as glycosylation, ubiquitination, or enzymatic cleavage.

The protein encoded by the cDNA may be purified using standard immunochromatography techniques. In such procedures, a solution containing the secreted protein, such as the culture medium or a cell extract, is applied to a column having antibodies against the secreted protein attached to the chromatography matrix. The secreted protein is allowed to bind the immunochromatography column. Thereafter, the column is washed to remove non-specifically bound proteins. The specifically bound secreted protein is then released from the column and recovered using standard techniques.

If antibody production is not possible, the cDNA sequence or a portion thereof may be incorporated into expression vectors designed for use in purification schemes employing chimeric polypeptides. In such strategies the coding sequence of the cDNA is inserted in frame with the gene encoding the other half of the chimera. The other half of the chimera may be β-globin or a nickel binding polypeptide encoding sequence. A chromatography matrix having antibody to β-globin or nickel attached thereto is then used to purify the chimeric protein. Protease cleavage sites may be engineered between the β-globin gene or the nickel binding polypeptide and the cDNA or portion thereof. Thus, the two polypeptides of the chimera may be separated from one another by protease digestion.

One useful expression vector for generating β-globin chimerics is pSG5 (Stratagene), which encodes rabbit β-globin. Intron II of the rabbit β-globin gene facilitates splicing of the expressed transcript, and the polyadenylation signal incorporated into the construct increases the level of expression. These techniques as described are well known to those skilled in the art of molecular biology. Standard methods are published in methods texts such as Davis et al., (Basic Methods in Molecular Biology, L. G. Davis, M. D. Dibner, and J. F. Battey, ed., Elsevier Press, NY, 1986) and many of the methods are available from Stratagene, Life Technologies, Inc., or Promega. Polypeptide may additionally be produced from the construct using in vitro translation systems such as the In vitro Express™ Translation Kit (Stratagene).

Following expression and purification of the secreted proteins encoded by the 5' ESTs, cDNAs, or portions thereof, the purified proteins may be tested for the ability to bind to the surface of various cell types as described in Example 31 below. It will be appreciated that a plurality of proteins expressed from these cDNAs may be included in a panel of proteins to be simultaneously evaluated for the activities specifically described below, as well as other biological roles for which assays for determining activity are available.

EXAMPLE 31

Analysis of Secreted Proteins to Determine Whether they Bind to the Cell Surface The proteins encoded by the 5' ESTs, cDNAs, or portions thereof are cloned into expression vectors such as those described in Example 30. The proteins are purified by size, charge, immunochromatography or other techniques familiar to those skilled in the art. Following purification, the proteins are labeled using techniques known to those skilled in the art. The labeled proteins are incubated with cells or cell lines derived from a variety of organs or tissues to allow the proteins to bind to any receptor present on the cell surface. Following the incubation, the cells are washed to remove non-specifically bound protein. The labeled proteins are detected by autoradiography. Alternatively, unlabeled proteins may be incubated with the cells and detected with antibodies having a detectable label, such as a fluorescent molecule, attached thereto.

Specificity of cell surface binding may be analyzed by conducting a competition analysis in which various amounts of unlabeled protein are incubated along with the labeled protein. The amount of labeled protein bound to the cell surface decreases as the amount of competitive unlabeled protein increases. As a control, various amounts of an unlabeled protein unrelated to the labeled protein is included in some binding reactions. The amount of labeled protein bound to the cell surface does not decrease in binding reactions containing increasing amounts of unrelated unlabeled protein, indicating that the protein encoded by the cDNA binds specifically to the cell surface.

As discussed above, secreted proteins have been shown to have a number of important physiological effects and, consequently, represent a valuable therapeutic resource. The secreted proteins encoded by the cDNAs or portions thereof made according to Examples 27-29 may be evaluated to determine their physiological activities as described below.

EXAMPLE 32

Assaying the Proteins Expressed from cDNAs for Cytokine, Cell Proliferation or Cell Differentiation Activity As discussed above, secreted proteins may act as cytokines or may affect cellular proliferation or differentiation. Many protein factors discovered to date, including all known cytokines, have exhibited activity in one or more factor dependent cell proliferation assays, and hence the assays serve as a convenient confirmation of cytokine activity. The activity of a protein of the present invention is evidenced by any one of a number of routine factor dependent cell proliferation assays for cell lines including, without limitation, 32D, DA2, DA1G, T10, B9, B9/11, BaF3, MC9/G, M+ (preB M+), 2E8, RB5, DA1, 123, T1165, HT2, CTLL2, TF-1, Mo7c and CMK. The proteins encoded by the above cDNAs may be evaluated for their ability to regulate T cell or thymocyte proliferation in assays such as those described above or in the following references, which are incorporated herein by reference: Current Protocols in Immunology, Ed. by J. E. Coligan et al., Greene Publishing Associates and Wiley-Interscience; Takai et al. J. Immunol. 137:3494-3500, 1986. Bertagnolli et al. J. Immunol. 145:1706-1712, 1990. Bertagnolli et al., Cellular Immunology 133:327-341, 1991. Bertagnolli, et al. J. Immunol. 149:3778-3783, 1992; Bowman et al., J. Immunol. 152: 1756-1761, 1994.

In addition, numerous assays for cytokine production and/or the proliferation of spleen cells, lymph node cells and thymocytes are known. These include the techniques disclosed in Current Protocols in Immunology. J. E. Coligan et al. Eds., Vol 1 pp. 3.12.1-3.12.14 John Wiley and Sons, Toronto. 1994; and Schreiber, R. D. In Current Protocols in Immunology., supra Vol 1 pp. 6.8.1-6.8.8, John Wiley and Sons, Toronto. 1994.

The proteins encoded by the cDNAs may also be assayed for the ability to regulate the proliferation and differentiation of hematopoietic or lymphopoietic cells. Many assays for such activity are familiar to those skilled in the art, including the assays in the following references, which are incorporated herein by reference: Bottomly, K., Davis, L. S. and Lipsky, P. E., Measurement of Human and Murine Interleukin 2 and Interleukin 4, In Current Protocols in Immunology., J. E. Coligan et al. Eds. Vol 1 pp. 6.3.1-6.3.12, John Wiley and Sons, Toronto. 1991; deVries et al., J. Exp. Med. 173:1205-1211, 1991; Moreau et al., Nature 36:690-692, 1988; Greenberger et al., Proc. Natl. Acad. Sci. U.S.A. 80:2931-2938, 1983; Nordan, R., Measurement of Mouse and Human Interleukin 6 In Current Protocols in Immunology. J. E. Coligan et al. Eds. Vol 1 pp. 6.6.1-6.6.5, John Wiley and Sons, Toronto. 1991; Smith et al., Proc. Natl. Acad. Sci. U.S.A. 83:1857-1861, 1986; Bennett, F., Giannotti, J., Clark, S. C. and Turner, K. J., Measurement of Human Interleukin 11 in Current Protocols in Immunology. J. E. Coligan et al. Eds. Vol 1 pp. 6.15.1 John Wiley and Sons, Toronto. 1991; Ciarletta, A., Giannotti, J., Clark, S. C. and Turner, K. J., Measurement of Mouse and Human Interleukin 9 In Current Protocols in Immunology. J. E. Coligan et al., Eds. Vol 1 pp. 6.13.1, John Wiley and Sons, Toronto. 1991.

The proteins encoded by the cDNAs may also be assayed for their ability to regulate T-cell responses to antigens. Many assays for such activity are familiar to those skilled in the art, including the assays described in the following references, which are incorporated herein by reference: Chapter 3 (In Vitro Assays for Mouse Lymphocyte Function), Chapter 6 (Cytokines and Their Cellular Receptors) and Chapter 7, (Immunologic Studies in Humans) in Current Protocols in Immunology, J. E. Coligan et al. Eds. Greene Publishing Associates and Wiley-Interscience; Weinberger et al., Proc. Natl. Acad. Sci. USA 77:6091-6095, 1980; Weinberger et al., Eur. J. Immun. 11:405-411, 1981; Takai et al., J. Immunol. 137:3494-3500, 1986; Takai et al., J. Immunol. 140:508-512, 1988.

Those proteins which exhibit cytokine, cell proliferation, or cell differentiation activity may then be formulated as pharmaceuticals and used to treat clinical conditions in which induction of cell proliferation or differentiation is beneficial. Alternatively, as described in more detail below, genes encoding these proteins or nucleic acids regulating the expression of these proteins may be introduced into appropriate host cells to increase or decrease the expression of the proteins as desired.

EXAMPLE 33

Assaying the Proteins Expressed from cDNAs or Portions thereof for Activity as Immune System Regulators The proteins encoded by the cDNAs or portions thereof may also be evaluated for their effects as immune regulators. For example, the proteins may be evaluated for their activity to influence thymocyte or splenocyte cytotoxicity. Numerous assays for such activity are familiar to those skilled in the art including the assays described in the following references, which are incorporated herein by reference: Chapter 3 (In Vitro Assays for Mouse Lymphocyte Function 3.1-3.19) and Chapter 7 (Immunologic studies in Humans) in Current Protocols in Immunology, J. E. Coligan et al. Eds, Greene Publishing Associates and Wiley-Interscience; Herrmann et al., Proc. Natl. Acad. Sci. USA 78:2488-2492, 1981; Herrmann et al., J. Immunol. 128:1968-1974, 1982; Handa et al., J. Immunol. 135:1564-1572, 1985; Takai et al., J. Immunol. 137: 3494-3500, 1986; Takai et al., J. Immunol. 140:508-512, 1988; Herrmann et al., Proc. Natl. Acad. Sci. USA 78:2488-2492, 1981; Herrmann et al., J. Immunol. 128:1968-1974, 1982; Handa et al., J. Immunol. 135:1564-1572, 1985; Takai et al., J. Immunol. 137:3494-3500, 1986; Bowman et al., J. Virology 61:1992-1998; Takai et al., J. Immunol. 140:508-512, 1988; Bertagnolli et al., Cellular Immunology 133:327-341, 1991; Brown et al., J. Immunol. 153:3079-3092, 1994.

The proteins encoded by the cDNAs or portions thereof may also be evaluated for their effects on T-cell dependent immunoglobulin responses and isotype switching. Numerous assays for such activity are familiar to those skilled in the art, including the assays disclosed in the following references, which are incorporated herein by reference: Maliszewski, J. Immunol. 144:3028-3033, 1990; Mond, J. J. and Brunswick, M Assays for B Cell Function: In vitro Antibody Production, Vol 1 pp. 3.8.1-3.8.16 in Current Protocols in Immunology. J. E. Coligan et al Eds., John Wiley and Sons, Toronto. 1994.

The proteins encoded by the cDNAs or portions thereof may also be evaluated for their effect on immune effector cells, including their effect on Th1 cells and cytotoxic lymphocytes. Numerous assays for such activity are familiar to those skilled in the art, including the assays disclosed in the following references, which are incorporated herein by reference: Chapter 3 (In Vitro Assays for Mouse Lymphocyte Function 3.1-3.19) and Chapter 7 (Immunologic Studies in Humans) in Current Protocols in Immunology, J. E. Coligan et al. Eds., Greene Publishing Associates and Wiley-Interscience; Takai et al., J. Immunol. 137:3494-3500, 1986; Takai et al.; J. Immunol. 140:508-512, 1988; Bertagnolli et al., J. Immunol. 149:3778-3783, 1992.

The proteins encoded by the cDNAs or portions thereof may also be evaluated for their effect on dendritic cell mediated activation of naive T-cells. Numerous assays for such activity are familiar to those skilled in the art, including the assays disclosed in the following references, which are incorporated herein by reference: Guery et al., J. Immunol. 134: 536-544, 1995; Inaba et al., Journal of Experimental Medicine 173:549-559, 1991; Macatonia et al., Journal of Immunology 154:5071-5079, 1995; Porgador et al., Journal of Experimental Medicine 182:255-260, 1995; Nair et al., Journal of Virology 67:4062-4069, 1993; Huang et al., Science 264:961-965, 1994; Macatonia et al., Journal of Experimental Medicine 169:1255-1264, 1989; Bhardwaj et al., Journal of Clinical Investigation 94:797-807, 1994; and Inaba et al., Journal of Experimental Medicine 172:631-640, 1990.

The proteins encoded by the cDNAs or portions thereof may also be evaluated for their influence on the lifetime of lymphocytes. Numerous assays for such activity are familiar to those skilled in the art, including the assays disclosed in the following references, which are incorporated herein by reference: Darzynkiewicz et al., Cytometry 13:795-808, 1992; Gorczyca et al., Leukemia 7:659-670, 1993; Gorczyca et al., Cancer Research 53:1945-1951, 1993; Itoh etal., Cell 66:233-243, 1991; Zacharchuk, Journal of Immunology 145: 4037-4045, 1990; Zamai et al., Cytometry 14:891-897, 1993; Gorczyca et al., International Journal of Oncology 1:639-648, 1992.

Assays for proteins that influence early steps of T-cell commitment and development include, without limitation, those described in: Antica et al., Blood 84:111-117, 1994; Fine et al., Cellular immunology 155:111-122, 1994; Galy et al., Blood 85:2770-2778, 1995; Toki et al., Proc. Nat. Acad Sci. USA 88:7548-7551, 1991.

Those proteins which exhibit activity as immune system regulators activity may then be formulated as pharmaceuticals and used to treat clinical conditions in which regulation of immune activity is beneficial.

For example, the protein may be useful in the treatment of various immune deficiencies and disorders (including severe combined immunodeficiency (SCID)), e.g., in regulating (up or down) growth and proliferation of T and/or B lymphocytes, as well as effecting the cytolytic activity of NK cells and other cell populations. These immune deficiencies may be genetic or be caused by viral (e.g., HIV) as well as bacterial or fungal infections, or may result from autoimmune disorders. More specifically, infectious diseases caused by viral, bacterial, fungal or other infection may be treatable using a protein of the present invention, including infections by HIV, hepatitis viruses, herpesviruses, mycobacteria, *Leishmania* spp., *malaria* spp. and various fungal infections such as candidiasis. Of course, in this regard, a protein of the present invention may also be useful where a boost to the immune system generally may be desirable, i.e., in the treatment of cancer.

Autoimmune disorders which may be treated using a protein of the present invention include, for example, connective tissue disease, multiple sclerosis, systemic lupus erythematosus, rheumatoid arthritis, autoimmune pulmonary inflammation, Guillain-Barre syndrome, autoimmune thyroiditis, insulin dependent diabetes mellitus, myasthenia gravis, graft-versus-host disease and autoimmune inflammatory eye disease. Such a protein of the present invention may also to be useful in the treatment of allergic reactions and conditions, such as asthma (particularly allergic asthma) or other respiratory problems. Other conditions, in which immune suppression is desired (including, for example, organ transplantation), may also be treatable using a protein of the present invention.

Using the proteins of the invention it may also be possible to regulate immune responses, in a number of ways. Down regulation may be in the form of inhibiting or blocking an immune response already in progress or may involve preventing the induction of an immune response. The functions of activated T-cells may be inhibited by suppressing T cell responses or by inducing specific tolerance in T cells, or both. Immunosuppression of T cell responses is generally an active, non-antigen-specific, process which requires continuous exposure of the T cells to the suppressive agent. Tolerance, which involves inducing non-responsiveness or anergy in T cells, is distinguishable from immunosuppression in that it is generally antigen-specific and persists after exposure to the tolerizing agent has ceased. Operationally, tolerance can be demonstrated by the lack of a T cell response upon reexposure to specific antigen in the absence of the tolerizing agent.

Down regulating or preventing one or more antigen functions (including without limitation B lymphocyte antigen functions (such as, for example, B7)), e.g., preventing high level lymphokine synthesis by activated T cells, will be useful in situations of tissue, skin and organ transplantation and in graft-versus-host disease (GVHD). For example, blockage of T cell function should result in reduced tissue destruction in tissue transplantation. Typically, in tissue transplants, rejection of the transplant is initiated through its recognition as foreign by T cells, followed by an immune reaction that destroys the transplant. The administration of a molecule which inhibits or blocks interaction of a B7 lymphocyte antigen with its natural ligand(s) on immune cells (such as a soluble, monomeric form of a peptide having B7-2 activity alone or in conjunction with a monomeric form of a peptide having an activity of another B lymphocyte antigen (e.g., B7-1, B7-3) or blocking antibody), prior to transplantation can lead to the binding of the molecule to the natural ligand(s) on the immune cells without transmitting the corresponding costimulatory signal. Blocking B lymphocyte antigen function in this matter prevents cytokine synthesis by immune cells, such as T cells, and thus acts as an immunosuppressant. Moreover, the lack of costimulation may also be sufficient to anergize the T cells, thereby inducing tolerance in a subject. Induction of long-term tolerance by B lymphocyte antigen-blocking reagents may avoid the necessity of repeated administration of these blocking reagents. To achieve sufficient immunosuppression or tolerance in a subject, it may also be necessary to block the function of a combination of B lymphocyte antigens.

The efficacy of particular blocking reagents in preventing organ transplant rejection or GVHD can be assessed using animal models that are predictive of efficacy in humans. Examples of appropriate systems which can be used include allergenic cardiac grafts in rats and xenogeneic pancreatic islet cell grafts in mice, both of which have been used to examine the immunosuppressive effects of CTLA4Ig fusion proteins in vivo as described in Lenschow et al., Science 257:789-792 (1992) and Turka et al., Proc. Natl. Acad. Sci USA, 89:11102-11105 (1992). In addition, murine models of GVHD (see Paul ed., Fundamental Immunology, Raven Press, New York, 1989, pp. 846-847) can be used to determine the effect of blocking B lymphocyte antigen function in vivo on the development of that disease.

Blocking antigen function may also be therapeutically useful for treating autoimmune diseases. Many autoimmune disorders are the result of inappropriate activation of T cells that are reactive against self tissue and which promote the production of cytokines and autoantibodies involved in the pathology of the diseases. Preventing the activation of autoreactive T cells may reduce or eliminate disease symptoms. Administration of reagents which block costimulation of T cells by disrupting receptor ligand interactions of B lymphocyte antigens can be used to inhibit T cell activation and prevent production of autoantibodies or T cell-derived cytokines which may be involved in the disease process. Additionally, blocking reagents may induce antigen-specific tolerance of autoreactive T cells which could lead to long-term relief from the disease. The efficacy of blocking reagents in preventing or alleviating autoimmune disorders can be determined using a number of well-characterized animal models of human autoimmune diseases. Examples include murine experimental autoimmune encephalitis, systemic lupus erythmatosis in MRL/pr/pr mice or NZB hybrid mice, murine autoimmuno collagen arthritis, diabetes mellitus in OD mice and BB rats, and murine experimental myasthenia gravis (see Paul ed., Fundamental Immunology, Raven Press, New York, 1989, pp. 840-856).

Upregulation of an antigen function (preferably a B lymphocyte antigen function), as a means of up regulating immune responses, may also be useful in therapy. Upregulation of immune responses may be in the form of enhancing an existing immune response or eliciting an initial immune response. For example, enhancing an immune response through stimulating B lymphocyte antigen function may be useful in cases of viral infection. In addition, systemic viral diseases such as influenza, the common cold, and encephalitis might be alleviated by the administration of stimulatory form of B lymphocyte antigens systemically.

Alternatively, anti-viral immune responses may be enhanced in an infected patient by removing T cells from the patient, costimulating the T cells in vitro with viral antigen-pulsed APCs either expressing a peptide of the present invention or together with a stimulatory form of a soluble peptide of the present invention and reintroducing the in vitro activated T cells into the patient. The infected cells would now be capable of delivering a costimulatory signal to T cells in vivo, thereby activating the T cells.

In another application, up regulation or enhancement of antigen function (preferably B lymphocyte antigen function) may be useful in the induction of tumor immunity. Tumor cells (e.g., sarcoma, melanoma, lymphoma, leukemia, neuroblastoma, carcinoma) transfected with a nucleic acid encoding at least one peptide of the present invention can be administered to a subject to overcome tumor-specific tolerance in the subject. If desired, the tumor cell can be transfected to express a combination of peptides. For example, tumor cells obtained from a patient can be transfected ex vivo with an expression vector directing the expression of a peptide having B7-2-like activity alone, or in conjunction with a peptide having B7-1-like activity and/or B7-3-like activity. The transfected tumor cells are returned to the patient to result in expression of the peptides on the surface of the transfected cell. Alternatively, gene therapy techniques can be used to target a tumor cell for transfection in vivo.

The presence of the peptide of the present invention having the activity of a B lymphocyte antigen(s) on the surface of the tumor cell provides the necessary costimulation signal to T cells to induce a T cell mediated immune response against the transfected tumor cells. In addition, tumor cells which lack MHC class I or MHC class II molecules, or which fail to reexpress sufficient amounts of MHC class I or MHC class II molecules, can be transfected with nucleic acids encoding all or a portion of (e.g., a cytoplasmic-domain truncated portion) of an MHC class I $\alpha$ chain protein and $\beta_2$ macroglobulin protein or an MHC class II $\alpha$ chain protein and an MHC class II $\alpha$ chain protein to thereby express MHC class I or MHC class II proteins on the cell surface. Expression of the appropriate class II or class II MHC in conjunction with a peptide having the activity of a B lymphocyte antigen (e.g., B7-1, B7-2, B7-3) induces a T cell mediated immune response against the transfected tumor cell. Optionally, a gene encoding an antisense construct which blocks expression of an MHC class II associated protein, such as the invariant chain, can also be cotransfected with a DNA encoding a peptide having the activity of a B lymphocyte antigen to promote presentation of tumor associated antigens and induce tumor specific immunity. Thus, the induction of a T cell mediated immune response in a human subject may be sufficient to overcome tumor-specific tolerance in the subject.

Alternatively, as described in more detail below, genes encoding these proteins or nucleic acids regulating the expression of these proteins may be introduced into appropriate host cells to increase or decrease the expression of the proteins as desired.

EXAMPLE 34

Assaying the Proteins Expressed from cDNAs or Portions thereof for Hematopoiesis Regulating Activity The proteins encoded by the cDNAs or portions thereof may also be evaluated for their hematopoiesis regulating activity. For example, the effect of the proteins on embryonic stem cell differentiation may be evaluated. Numerous assays for such activity are familiar to those skilled in the art, including the assays disclosed in the following references, which are incorporated herein by reference: Johansson et al. Cellular Biology 15:141-151, 1995; Keller et al., Molecular and Cellular Biology 13:473-486, 1993; McClanahan et al., Blood 81:2903-2915, 1993.

The proteins encoded by the cDNAs or portions thereof may also be evaluated for their influence on the lifetime of stem cells and stem cell differentiation. Numerous assays for such activity are familiar to those skilled in the art, including the assays disclosed in the following references, which are incorporated herein by reference: Freshney, M. G. Methylcellulose Colony Forming Assays, in Culture of Hematopoietic Cells. R. I. Freshney, et al. Eds. pp. 265-268, Wiley-Liss, Inc., New York, N.Y. 1994; Hirayama et al., Proc. Natl. Acad. Sci. USA 89:5907-5911, 1992; McNiece, I. K. and Briddell, R. A. Primitive Hematopoietic Colony Forming Cells with High Proliferative Potential, in Culture of Hematopoietic Cells. R. I. Freshney, et al. eds. Vol pp. 23-39, Wiley-Liss, Inc., New York, N.Y. 1994; Neben et al., Experimental Hematology 22:353-359, 1994; Ploemacher, R. E. Cobblestone Area Forming Cell Assay, In Culture of Hematopoietic Cells. R. I. Freshney, et al. Eds. pp. 1-21, Wiley-Liss, Inc., New York, N.Y. 1994; Spooncer, E., Dexter, M. and Allen, T. Long Term Bone Marrow Cultures in the Presence of Stromal Cells, in Culture of Hematopoietic Cells. R. I. Freshney, et al. Eds. pp. 163-179, Wiley-Liss, Inc., New York, N.Y. 1994; Sutherland, H. J. Long Term Culture Initiating Cell Assay, in Culture of Hematopoietic Cells. R. I. Freshney, et al. Eds. pp. 139-162, Wiley-Liss, Inc., New York, N.Y. 1994.

Those proteins which exhibit hematopoiesis regulatory activity may then be formulated as pharmaceuticals and used to treat clinical conditions in which regulation of hematopoiesis is beneficial.

For example, a protein of the present invention may be useful in regulation of hematopoiesis and, consequently, in the treatment of myeloid or lymphoid cell deficiencies. Even marginal biological activity in support of colony forming cells or of factor-dependent cell lines indicates involvement in regulating hematopoiesis, e.g. in supporting the growth and proliferation of erythroid progenitor cells alone or in combination with other cytokines, thereby indicating utility, for example, in treating various anemias or for use in conjunction with irradiation/chemotherapy to stimulate the production of erythroid precursors and/or erythroid cells; in supporting the growth and proliferation of myeloid cells such as granulocytes and monocytes/macrophages (i.e., traditional CSF activity) useful, for example, in conjunction with chemotherapy to prevent or treat consequent myelo-suppression; in supporting the growth and proliferation of megakaryocytes and consequently of platelets thereby allowing prevention or treatment of various platelet disorders such as thrombocytopenia, and generally for use in place of or complimentary to platelet transfusions; and/or in supporting the growth and proliferation of hematopoietic stem cells which are capable of maturing to any and all of the above-mentioned hematopoietic cells and therefore find therapeutic utility in various stem cell disorders (such as those usually treated with transplantation, including, without limitation, aplastic anemia and paroxysmal nocturnal hemoglobinuria), as well as in repopulating the stem cell compartment post irradiation/chemotherapy, either in-vivo or ex-vivo (i.e., in conjunction with bone marrow transplantation or with peripheral progenitor cell transplantation (homologous or heterologous)) as normal cells or genetically anipulated for gene therapy. Alternatively, as described in more detail below, genes encoding these proteins or nucleic acids regulating the expression of these proteins may be introduced into appropriate host cells to increase or decrease the expression of the proteins as desired.

EXAMPLE 35

Assaying the Proteins Expressed from Extended cDNAs or Portions thereof for Regulation of Tissue Growth The proteins encoded by the extended cDNAs or portions thereof may also be evaluated for their effect on tissue growth. Numerous assays for such activity are familiar to those skilled in the art, including the assays disclosed in International Patent Publication No. WO95/16035, International Patent Publication No. WO95/05846 and International Patent Publication No. WO91/07491, which are incorporated herein by reference.

Assays for wound healing activity include, without limitation, those described in: Winter, *Epidermal Wound Healing*, pps. 71-112 (Maibach, Hl and Rovee, D T, eds.), Year Book Medical Publishers, Inc., Chicago, as modified by Eaglstein and Mertz, J. Invest. Dermatol 71:382-84 (1978) which are incorporated herein by reference.

Those proteins which are involved in the regulation of tissue growth may then be formulated as pharmaceuticals and used to treat clinical conditions in which regulation of tissue growth is beneficial. For example, a protein of the present invention also may have utility in compositions used for bone, cartilage, tendon, ligament and/or nerve tissue growth or regeneration, as well as for wound healing and tissue repair and replacement, and in the treatment of burns, incisions and ulcers.

A protein of the present invention, which induces cartilage and/or bone growth in circumstances where bone is not normally formed, has application in the healing of bone fractures and cartilage damage or defects in humans and other animals. Such a preparation employing a protein of the invention may have prophylactic use in closed as well as open fracture reduction and also in the improved fixation of artificial joints. De novo bone formation induced by an osteogenic agent contributes to the repair of congenital, trauma induced, or oncologic resection induced craniofacial defects, and also is useful in cosmetic plastic surgery.

A protein of this invention may also be used in the treatment of periodontal disease, and in other tooth repair processes. Such agents may provide an environment to attract bone-forming cells, stimulate growth of bone-forming cells or induce differentiation of progenitors of bone-forming cells. A protein of the invention may also be useful in the treatment of osteoporosis or osteoarthritis, such as through stimulation of bone and/or cartilage repair or by blocking inflammation or processes of tissue destruction (collagenase activity, osteoclast activity, etc.) mediated by inflammatory processes.

Another category of tissue regeneration activity that may be attributable to the protein of the present invention is tendon/ligament formation. A protein of the present invention, which induces tendon/ligament-like tissue or other tissue formation in circumstances where such tissue is not normally formed, has application in the healing of tendon or ligament tears, deformities and other tendon or ligament defects in humans and other animals. Such a preparation employing a tendon/ligament-like tissue inducing protein may have prophylactic use in preventing damage to tendon or ligament tissue, as well as use in the improved fixation of tendon or ligament to bone or other tissues, and in repairing defects to tendon or ligament tissue. De novo tendon/ligament-like tissue formation induced by a composition of the present invention contributes to the repair of congenital, trauma induced, or other tendon or ligament defects of other origin, and is also useful in cosmetic plastic surgery for attachment or repair of tendons or ligaments. The compositions of the present invention may provide an environment to attract tendon- or ligament-forming cells, stimulate growth of tendon- or ligament-forming cells, induce differentiation of progenitors of tendon- or ligament-forming cells, or induce growth of tendon/ligament cells or progenitors ex vivo for return in vivo to effect tissue repair. The compositions of the invention may also be useful in the treatment of tendinitis, carpal tunnel syndrome and other tendon or ligament defects. The compositions may also include an appropriate matrix and/or sequestering agent as a carrier as is well known in the art.

The protein of the present invention may also be useful for proliferation of neural cells and for regeneration of nerve and brain tissue, i.e., for the treatment of central and peripheral nervous system diseases and neuropathies, as well as mechanical and traumatic disorders, which involve degeneration, death or trauma to neural cells or nerve tissue. More specifically, a protein may be used in the treatment of diseases of the peripheral nervous system, such as peripheral nerve injuries, peripheral neuropathy and localized neuropathies, and central nervous system diseases, such as Alzheimer's, Parkinson's disease, Huntington's disease, amyotrophic lateral sclerosis, and Shy-Drager syndrome. Further conditions which may be treated in accordance with the present invention include mechanical and traumatic disorders, such as spinal cord disorders, head trauma and cerebrovascular diseases such as stroke. Peripheral neuropathies resulting from chemotherapy or other medical therapies may also be treatable using a protein of the invention.

Proteins of the invention may also be useful to promote better or faster closure of non-healing wounds, including without limitation pressure ulcers, ulcers associated with vascular insufficiency, surgical and traumatic wounds, and the like.

It is expected that a protein of the present invention may also exhibit activity for generation or regeneration of other tissues, such as organs (including, for example, pancreas, liver, intestine, kidney, skin, endothelium) muscle (smooth, skeletal or cardiac) and vascular (including vascular endotheliun) tissue, or for promoting the growth of cells comprising such tissues. Part of the desired effects may be by inhibition or modulation of fibrotic scarring to allow normal tissue to generate. A protein of the invention may also exhibit angiogenic activity.

A protein of the present invention may also be useful for gut protection or regeneration and treatment of lung or liver fibrosis, reperfusion injury in various tissues, and conditions resulting from systemic cytokinc damage.

A protein of the present invention may also be useful for promoting or inhibiting differentiation of tissues described above from precursor tissues or cells; or for inhibiting the growth of tissues described above.

Alternatively, as described in more detail below, genes encoding these proteins or nucleic acids regulating the expression of these proteins may be introduced into appropriate host cells to increase or decrease the expression of the proteins as desired.

EXAMPLE 36

Assaying the Proteins Expressed from cDNAs or Portions thereof for Regulation of Reproductive Hormones or Cell Movement The proteins encoded by the cDNAs or portions thereof may also be evaluated for their ability to regulate reproductive hormones, such as follicle stimulating hormone. Numerous assays for such activity are familiar to those skilled in the art, including the assays disclosed in the following references, which are incorporated herein by reference: Vale et al., Endocrinology 91:562-572, 1972; Ling et al., Nature 321:779-782, 1986; Vale et al., Nature 321:776-779, 1986; Mason et al., Nature 318:659-663, 1985; Forage et al., Proc. Natl. Acad. Sci. USA 83:3091-3095, 1986. Chapter 6.12 (Measurement of Alpha and Beta Chemokines) Current Protocols in Immunology, J. E. Coligan et al. Eds. Greene Publishing Associates and Wiley-Intersciece; Taub et al. J. Clin. Invest. 95:1370-1376, 1995; Lind et al. APMIS 103:140-146, 1995; Muller et al. Eur. J. Immunol. 25:1744-1748; Gruber et al. J. of Immunol. 152:5860-5867, 1994; Johnston et al. J. of Immunol. 153:1762-1768, 1994.

Those proteins which exhibit activity as reproductive hormones or regulators of cell movement may then be formulated as pharmaceuticals and used to treat clinical conditions in which regulation of reproductive hormones or cell movement are beneficial.

For example, a protein of the present invention may also exhibit activin- or inhibin-related activities. inhibins are characterized by their ability to inhibit the release of follicle stimulating hormone (FSH), while activins are characterized by their ability to stimulate the release of folic stimulating horme (FSH). Thus, a protein of the present invention, alone or in heterodimers with a member of the Inhibin α family, may be useful as a contraceptive based on the ability of inhibins to decrease fertility in female mammals and decrease spermatogenesis in male mammals. Administration of sufficient amounts of other inhibins can induce infertility in these mammals. Alternatively, the protein of the invention, as a homodimer or as a heterodimer with other protein subunits of the inhibin-B group, may be useful as a fertility inducing therapeutic, based upon the ability of activin molecules in stimulating FSH release from cells of the anterior pituitary. See, for example, U.S. Pat. No. 4,798,885, the disclosure of which is incorporated herein by reference. A protein of the invention may also be useful for advancement of the onset of fertility in sexually immature mammals, so as to increase the lifetime reproductive performance of domestic animals such as cows, sheep and pigs.

Alternatively, as described in more detail below, genes encoding these proteins or nucleic acids regulating the expression of these proteins may be introduced into appropriate host cells to increase or decrease the expression of the proteins as desired.

EXAMPLE 36A

Assaying the Proteins Expressed from cDNAs or Portions thereof for Chemotactic/Chemokinetic Activity The proteins encoded by the cDNAs or portions thereof may also be evaluated for chemotacti/chemokinetic activity. For example, a protein of the present invention may have chemotactic or chemokinetic activity (e.g., act as a chemokine) for mammalian cells, including, for example, monocytes, fibroblasts, neutrophils, T-cells, mast cells, cosinophils, epithelial and/or endothelial cells. Chemotactic and chmokinetic proteins can be used to mobilize or attract a desired cell population to a desired site of action. Chemotactic or chemokinetic proteins provide particular advantages in treatment of wounds and other trauma to tissues, as well as in treatment of localized infections. For example, attraction of lymphocytes, monocytes or neutrophils to tumors or sites of infection may result in improved immune responses against the tumor or infecting agent.

A protein or peptide has chemotactic activity for a particular cell population if it can stimulate, directly or indirectly, the directed orientation or movement of such cell population. Preferably, the protein or peptide has the ability to directly stimulate directed movement of cells. Whether a particular protein has chemotactic activity for a population of cells can be readily determined by employing such protein or peptide in any known assay for cell chemotaxis.

The activity of a protein of the invention may, among other means, be measured by the following methods:

Assays for chemotactic activity (which will identify proteins that induce or prevent chemotaxis) consist of assays that measure the ability of a protein to induce the migration of cells across a membrane as well as the ability of a protein to induce the adhesion of one cell population to another cell population. Suitable assays for movement and adhesion include, without limitation, those described in: Current Protocols in Immunology, Ed by J. E. Coligan, A. M. Kruisbeek, D. H. Margulies, E. M. Shevach, W. Strober, Pub. Greene Publishing Associates and Wiley-Interscience (Chapter 6.12, Measurement of alpha and beta Chemokincs 6.12.1-6.12.28; Taub et al. J. Clin. Invest. 95:1370-1376, 1995; Lind et al. APMIS 103:140-146, 1995; Mueller et al Eur. J. Immunol. 25:1744-1748; Gruber et al. J. of Immunol. 152:5860-5867, 1994; Johnston et al. J. of Immunol, 153:1762-1768, 1994.

EXAMPLE 37

Assaying the Proteins Expressed from cDNAs or Portions thereof for Regulation of Blood Clotting The proteins encoded by the cDNAs or portions thereof may also be evaluated for their effects on blood clotting. Numerous assays for such activity are familiar to those skilled in the art, including the assays disclosed in the following references, which are incorporated herein by reference: Linet et al., J. Clin. Pharmacol. 26:131-140, 1986; Burdick et al., Thrombosis Res. 45:413-419, 1987; Humphrey et al., Fibrinolysis 5:71-79 (1991); Schaub, Prostaglandins 35:467-474, 1988.

Those proteins which are involved in the regulation of blood clotting may then be formulated as pharmaceuticals and used to treat clinical conditions in which regulation of blood clotting is beneficial.

For example, a protein of the invention may also exhibit hemostatic or thrombolytic activity. As a result, such a protein is expected to be useful in treatment of various coagulations disorders (including hereditary disorders, such as hemophilias) or to enhance coagulation and other hemostatic events in treating wounds resulting from trauma, surgery or other causes. A protein of the invention may also be useful for dissolving or inhibiting formation of thromboses and for treatment and prevention of conditions resulting therefrom (such as,for example, infarction of cardiac and central nervous system vessels (e.g., stroke).

Alternatively, as described in more detail below, genes encoding these proteins or nucleic acids regulating the expression of these proteins may be introduced into appropriate host cells to increase or decrease the expression of the proteins as desired.

EXAMPLE 38

Assaying the Proteins Expressed from cDNAs or Portions thereof for Involvement in Receptor/Ligand Interactions The proteins encoded by the cDNAs or portions thereof may also be evaluated for their involvement in receptor/ligand interactions. Numerous assays for such involvement are familiar to those skilled in the art, including the assays disclosed in the following references, which are incorporated herein by reference: Chapter 7.28 (Measurement of Cellular Adhesion under Static Conditions 7.28.1-7.28.22) in Current Protocols in Immunology, J. E. Coligan et al. Eds. Greene Publishing Associates and Wiley-Interscience; Takai et al., Proc. Natl. Acad. Sci. USA 84:6864-6868, 1987; Bierer et al., J. Exp. Med. 168:1145-1156, 1988; Rosenstein et al., J. Exp. Med. 169:149-160, 1989; Stoltenborg et al., J. Immunol. Methods 175:59-68, 1994; Stitt et al., Cell 80:661-670, 1995; Gyuris et al., Cell 75:791-803, 1993.

For example, the proteins of the present invention may also demonstrate activity as receptors, receptor ligands or inhibitors or agonists of receptor/ligand interactions. Examples of such receptors and ligands include, without limitation, cytokine receptors and their ligands, receptor kinases and their ligands, receptor phosphatases and their ligands, receptors involved in cell-cell interactions and their ligands (including without limitation, cellular adhesion molecules (such as sclectins, integrins and their ligands) and receptor/ligand pairs involved in antigen presentation, antigen recognition and development of cellular and humoral immune respones). Receptors and ligands are also useful for screening of potential peptide or small molecule inhibitors of the relevant receptor/ligand interaction. A protein of the present invention (including, without limitation, fragments of receptors and ligands) may themselves be useful as inhibitors of receptor/ligand interactions.

EXAMPLE 38A

Assaying the Proteins Expressed from cDNAs or Portions thereof for Anti-Inflammatory Activity The proteins encoded by the cDNAs or portions thereof may also be evaluated for anti-inflammatory activity. The anti-inflammatory activity may be achieved by providing a stimulus to cells involved in the inflammatory response, by inhibiting or promoting cell-cell interactions (such as, for example, cell adhesion), by inhibiting or promoting chemotaxis of cells involved in the inflammatory process, inhibiting or promoting cell extravasation, or by stimulating or suppressing production of other factors which more directly inhibit or promote an inflammatory response. Proteins exhibiting such activities can be used to treat inflammatory conditions including chronic or acute conditions), including without limitation inflammation associated with infection (such as septic shock, sepsis or systemic inflammatory response syndrome (SIRS)), ischemic-reperfusioninury, endotoxin lethality, arthritis, complement-mediated hyperacute rejection, nephritis, cytokine or chemokine-induced lung injury, inflammatory bowel disease, Crohn's disease or resulting from over production of cytokines such as TNF or IL-1. Proteins of the invention may also be useful to treat anaphylaxis and hypersensitivity to an antigenic substance or material.

EXAMPLE 38B

Assaying the Proteins Expressed from cDNAs or Portions thereof for Tumor Inhibition Activity The proteins encoded by the cDNAs or portions thereof may also be evaluated for tumor inhibition activity. In addition to the activities described above for immunological treatment or prevention of tumors, a protein of the invention may exhibit other anti-tumor activities. A protein may inhibit tumor growth directly or indirectly (such as, for example, via ADCC). A protein may exhibit its tumor inhibitory activity by acting on tumor tissue or tumor precursor tissue, by inhibiting formation of tissues necessary to support tumor growth (such as, for example, by inhibiting angiogenesis), by causing production of other factors, agents or cell types which inhibit tumor growth, or by suppressing, eliminating or inhibiting factors, agents or cell types which promote tumor growth.

A protein of the invention may also exhibit one or more of the following additional activities or effects: inhibiting the growth, infection or function of, or killing, infectious agents, including, without limitation, bacteria, viruses, fungi and other parasites; effecting (suppressing or enhancing) bodily characteristics, including, without limitation, height, weight, hair color, eye color, skin, fat to lean ratio or other tissue pigmentation, or organ or body part size or shape (such as, for example, breast augmentation or diminution, change in bone form or shape); effecting biorhythms or circadian cycles or rhythms; effecting the fertility of male or female subjects; effecting the metabolism, catabolism, anabolism, processing, utilization, storage or elimination of dietary fat, lipid, protein, carbohydrate, vitamins, minerals, cofactors or other nutritional factors or component(s); effecting behavioral characteristics, including, without limitation, appetite, libido, stress, cognition (including cognitive disorders), depression (including depressive disorders) and violent behaviors; providing analgesic effects or other pain reducing effects; promoting differentiation and growth of embryonic stem cells in lineages other than hematopoietic lineages; hormonal or endocrine activity; in the case of enzymes, correcting deficiencies of the enzyme and treating deficiency-related diseases; treatment of hyperproliferative disorders (such as, for example, psoriasis); immunoglobulin-like activity (such as, for example, the ability to bind antigens or complement); and the ability to act as an antigen in a vaccine composition to raise an immune response against such protein or another material or entity which is cross-reactive with such protein.

EXAMPLE 39

Identification of Proteins which Interact with Polypeptides Encoded by 5' ESTs

Proteins which interact with the polypeptides encoded by cDNAs derived from the 5' ESTs or fragments thereof, such as receptor proteins, may be identified using two hybrid systems such as the Matchmaker Two Hybrid System 2 (Catalog No. K1604-1, Clontech). As described in the manual accompanying the Matchmaker Two Hybrid System 2 (Catalog No. K1604-1, Clontech), which is incorporated herein by reference, the cDNAs derived from 5' ESTs, or fragments thereof, are inserted into an expression vector such that they are in frame with DNA encoding the DNA binding domain of the yeast transcriptional activator GAL4. cDNAs in a cDNA library which encode proteins which might interact with the polypeptides encoded by cDNAs derived from the 5' ESTs or fragments thereof are inserted into a second expression vector such that they are in frame with DNA encoding the activation domain of GAL4. The two expression plasmids are transformed into yeast and the yeast are plated on selection medium which selects for expression of selectable markers on each of the expression vectors as well as GAL4 dependent expression of the HIS3 gene. Transformants capable of growing on medium lacking histidine are screened for GAL4 dependent lacZ expression. Those cells which are positive in both the histidine selection and the lacZ assay contain plasmids encoding proteins which interact with the polypeptide encoded by the cDNAs derived from the 5' ESTs or fragments thereof.

Alternatively, the system described in Lustig et al., Methods in Enzymology 283: 83-99 (1997), the disclosure of which is incorporated herein by reference, may be used for identifying molecules which interact with the polypeptides encoded by extended cDNAs. In such systems, in vitro transcription reactions are performed on a pool of vectors containing extended cDNA inserts cloned downstream of a promoter which drives in vitro transcription. The resulting pools of mRNAs are introduced into *Xenopus laevis* oocytes. The oocytes are then assayed for a desired acitivity.

Alternatively, the pooled in vitro transcription products produced as described above may be translated in vitro. The pooled in vitro translation products can be assayed for a desired activity or for interaction with a known polypeptide.

Proteins or other molecules interacting with polypeptides encoded by extended cDNAs can be found by a variety of additional techniques. In one method, affinity columns containing the polypeptide encoded by the extended cDNA or a portion thereof can be constructed. In some versions, of this method the affinity column contains chimeric proteins in which the protein encoded by the extended cDNA or a portion thereof is fused to glutathione S-transferase. A mixture of cellular proteins or pool of expressed proteins as described above and is applied to the affinity column. Proteins interacting with the polypeptide attached to the column can then be isolated and analyzed on 2-D electrophoresis gel as described in Ramunsen et al. Electrophoresis, 18, 588-598 (1997), the disclosure of which is incorporated herein by reference. Alternatively, the proteins retained on the affinity column can be purified by electrophoresis based methods and sequenced. The same method can be used to isolate antibodies, to screen phage display products, or to screen phage display human antibodies.

Proteins interacting with polypeptides encoded by extended cDNAs or portions thereof can also be screened by using an Optical Biosensor as described in Edwards et Leatherbarrow, Analytical Biochemistry, 246, 1-6 (1997), the disclosure of which is incorporated herein by reference. The main advantage of the method is that it allows the determination of the association rate between the protein and other interacting molecules. Thus, it is possible to specifically select interacting molecules with a high or low association rate. Typically a target molecule is linked to the sensor surface (through a carboxymethl dextran matrix) and a sample of test molecules is placed in contact with the target molecules. The binding of a test molecule to the target molecule causes a change in the refractive index and/or thickness. This change is detected by the Biosensor provided it occurs in the evanescent field (which extend a few hundred manometers from the sensor surface). In these screening assays, the target molecule can be one of the polypeptides encoded by extended cDNAs or a portion thereof and the test sample can be a collection of proteins extracted from tissues or cells, a pool of expressed proteins, combinatorial peptide and/or chemical libraries,or phage displayed peptides. The tissues or cells from which the test proteins are extracted can originate from any species.

In other methods, a target protein is immobilized and the test population is a collection of unique polypeptides encoded by the extended cDNAs or portions thereof.

To study the interaction of the proteins encoded by the extended cDNAs or portions thereof with drugs, the microdialysis coupled to HPLC method described by Wang et al., Chromatographia, 44, 205-208 (1997) or the affinity capillary electrophoresis method described by Busch et al., J. Chromatogr. 777:311-328 (1997), the disclosures of which are incorporated herein by reference can be used. The system described in U.S. Pat. No. 5,654,150, the disclosure of which is incorporated herein by reference, may also be used to identify molecules which interact with the polypeptides encoded by the extended cDNAs. In this system, pools of extended cDNAs are transcribed and translated in vitro and the reaction products are assayed for interaction with a known polypeptide or antibody.

It will be appreciated by those skilled in the art that the proteins expressed from the cDNAs or portions thereof may be assayed for numerous activities in addition to those specifically enumerated above. For example, the expressed proteins may be evaluated for applications involving control and regulation of inflammation, tumor proliferation or metastasis, infection, or other clinical conditions. In addition, the proteins expressed from the cDNAs or portions thereof may be useful as nutritional agents or cosmetic agents.

Epitopes and Antibody Fusions

A preferred embodiment of the present invention is directed to epitope-bearing polypeptides and epitope-bearing polypeptide fragments. These epitopes may be "antigenic epitopes" or both an "antigenic epitope" and an "immunogenic epitope". An "immunogenic epitope" is defined as a part of a protein that elicits an antibody response in vivo when the polypeptide is the immunogen. On the other hand, a region of polypeptide to which an antibody binds is defined as an "antigenic determinant" or "antigenic epitope." The number of immunogenic epitopes of a protein generally is less than the number of antigenic epitopes. See, e.g., Geysen, et al. (1983) Proc. Natl. Acad. Sci. USA 81:39984002. It is particularly noted that although a particular epitope may not be immunogenic, it is nonetheless useful since antibodies can be made in vitro to any epitope.

An epitope can comprise as few as 3 amino acids in a spatial conformation which is unique to the epitope. Generally an epitope consists of at least 6 such amino acids, and more often at least 8-10 such amino acids. In preferred embodiment, antigenic epitopes comprise a number of amino acids that is any integer between 3 and 50. Fragments which function as epitopes may be produced by any conventional means. See, e.g., Houghten, R. A., Proc. Natl. Acad. Sci. USA 82:5131-5135 (1985), further described in U.S. Pat. No. 4,631,211. Methods for determining the amino acids which make up an epitope include x-ray crystallography, 2-dimensional nuclear magnetic resonance, and epitope mapping, e.g., the Pepscan method described by H. Mario Geysen et al. (1984);. Proc. Natl. Acad. Sci. U.S.A. 81:3998-4002; PCT Publication No. WO 84/03564; and PCT Publication No. WO 84/03506. Another example is the algorithm of Jameson and Wolf, Comp. Appl. Biosci. 4:181-186 (1988) (said references incorporated by reference in their entireties). The Jameson-Wolf antigenic analysis, for example, may be performed using the computer program PROTEAN, using default parameters (Version 3.11 for the Power MacIntosh, DNASTAR, Inc., 1228 South Park Street Madison, Wis.

Antigenic epitopes are useful, for example, to raise antibodies, including monoclonal antibodies, that specifically bind the epitope. (See, for instance, Wilson et al., Cell 37:767-778 (1984); Sutcliffe, J. G. et al., Science 219:660-666 (1983).)

Similarly, immunogenic epitopes can be used to induce antibodies according to methods well known in the art. (See, for instance, Sutcliffe et al., supra; Wilson et al., supra; Chow, M. et al., Proc. Natl. Acad. Sci. USA 82:910-914; and Bittle, F. J. et al., J. Gen. Virol. 66:2347-2354 (1985).) A preferred immunogenic epitope includes the secreted protein. The immunogenic epitopes may be presented together with a carrier protein, such as an albumin, to an animal system (such as rabbit or mouse) or, if it is long enough (at least about 25 amino acids), without a carrier. However, immunogenic epitopes comprising as few as 8 to 10 amino acids have been shown to be sufficient to raise antibodies capable of binding to, at the very least, linear epitopes in a denatured polypeptide (e.g., in Western blotting.)

Epitope-bearing polypeptides of the present invention are used to induce antibodies according to methods well known in the art including, but not limited to, in vivo immunization, in vitro immunization, and phage display methods. See, e.g., Sutcliffe, et al., supra; Wilson, et al., supra, and Bittle, et al. (1985) J. Gen. Virol. 66:2347-2354. If in vivo immunization is used, animals may be immunized with free peptide; however, anti-peptide antibody titer may be boosted by coupling of the peptide to a macromolecular carrier, such as keyhole limpet hemacyanin (KLH) or tetanus toxoid. For instance, peptides containing cysteine residues may be coupled to a carrier using a linker such as -maleimidobenzoyl-N-hydroxysuccinimide ester (MBS), while other peptides may be coupled to carriers using a more general linking agent such as glutaraldehyde. Animals such as rabbits, rats and mice are immunized with either free or carrier-coupled peptides, for instance, by intraperitoneal and/or intradermal injection of emulsions containing about 100 μgs of peptide or carrier protein and Freund's adjuvant. Several booster injections may be needed, for instance, at intervals of about two weeks, to provide a useful titer of anti-peptide antibody which can be detected, for example, by ELISA assay using free peptide adsorbed to a solid surface. The titer of anti-peptide antibodies in serum from an immunized animal may be increased by selection of anti-peptide antibodies, for instance, by adsorption to the peptide on a solid support and elution of the selected antibodies according to methods well known in the art.

As one of skill in the art will appreciate, and discussed above, the polypeptides of the present invention comprising an immunogenic or antigenic epitope can be fused to heterologous polypeptide sequences. For example, the polypeptides of the present invention may be fused with the constant domain of immunoglobulins (IgA, IgE, IgG, IgM), or portions thereof (CH1, CH2, CH3, any combination thereof including both entire domains and portions thereof) resulting in chimeric polypeptides. These fusion proteins facilitate purification, and show an increased half-life in vivo. This has been shown, e.g., for chimeric proteins consisting of the first two domains of the human CD4-polypeptide and various domains of the constant regions of the heavy or light chains of mammalian immunoglobulins. See, e.g., EPA 0,394,827; Traunecker et al. (1988) Nature 331:84-86. Fusion proteins that have a disulfide-linked dimeric structure due to the IgG portion can also be more efficient in binding and neutralizing other molecules than monomeric polypeptides or fragments thereof alone. See, e.g., Fountoulakis et al. (1995) J. Biochem. 270:3958-3964. Nucleic acids encoding the above epitopes can also be recombined with a gene of interest as an epitope tag to aid in detection and purification of the expressed polypeptide.

Additonal fusion proteins of the invention may be generated through the techniques of gene-shuffling, motif-shuffling, exon-shuffling, or codon-shuffling (collectively referred to as "DNA shuffling"). DNA shuffling may be employed to modulate the activities of polypeptides of the present invention thereby effectively generating agonists and antagonists of the polypeptides. See, for example, U.S. Pat. Nos.: 5,605,793; 5,811,238; 5,834,252; 5,837,458; and Patten, P. A., et al., Curr. Opinion Biotechnol. 8:724-733 (1997); Harayama, S., Trends Biotechnol. 16(2):76-82 (1998); Hansson, L. O., et al. J. Mol. Biol. 287:265-276 (1999); and Lorenzo, M. M. and Blasco, R., Biotechniques 24(2):308-313 (1998) (each of these documents are hereby incorporated by reference). In one embodiment, one or more components, motifs, sections, parts, domains, fragments, etc., of coding polynucleotides of the invention, or the polypeptides encoded thereby may be recombined with one or more components, motifs, sections, parts, domains, fragments, etc. of one or more heterologous molecules.

Antibodies

The present invention further relates to antibodies and T-cell antigen receptors (TCR) which specifically bind the polypeptides of the present invention. The antibodies of the present invention include IgG (including IgG1, IgG2, IgG3, and IgG4), IgA (including IgA1 and IgA2), IgD, IgE, or IgM, and IgY. As used herein, the term "antibody" (Ab) is meant to include whole antibodies, including single-chain whole antibodies, and antigen-binding fragments thereof. In a preferred embodiment the antibodies are human antigen binding antibody fragments of the present invention include, but are not limited to, Fab, Fab' F(ab)2 and F(ab')2, Fd, single-chain Fvs (scFv), single-chain antibodies, disulfide-linked Fvs (sdFv) and fragments comprising either a $V_L$ or $V_H$ domain. The antibodies may be from any animal origin including birds and mammals. Preferably, the antibodies are human, murine, rabbit, goat, guinea pig, camel, horse, or chicken.

Antigen-binding antibody fragments, including single-chain antibodies, may comprise the variable region(s) alone or in combination with the entire or partial of the following: hinge region, CH1, CH2, and CH3 domains. Also included in the invention are any combinations of variable region(s) and hinge region, CH1, CH2, and CH3 domains. The present invention further includes chimeric, humanized, and human monoclonal and polyclonal antibodies which specifically bind the polypeptides of the present invention. The present invention further includes antibodies which are anti-idiotypic to the antibodies of the present invention.

The antibodies of the present invention may be monospecific, bispecific, trispecific or of greater multispecificity. Multispecific antibodies may be specific for different epitopes of a polypeptide of the present invention or may be specific for both a polypeptide of the present invention as well as for heterologous compositions, such as a heterologous polypeptide or solid support material. See, e.g., WO 93/17715; WO 92/08802; WO 91/00360; WO 92/05793; Tutt, A. et al. (1991) J. Immunol. 147:60-69; U.S. Pat. Nos. 5,573,920, 4,474,893, 5,601,819, 4,714,681, 4,925,648; Kostelny, S. A. et al. (1992) J. Immunol. 148:1547-1553.

In some embodiments, the antibodies may be capable of specifically binding to a protein or polypeptide encoded by 5' ESTs (or cDNAs or genomic DNAs obtainable therefrom), fragments of 5' ESTs (or cDNAs or genomic DNAs obtainable therefrom), positional segments of 5' ESTs (or cDNAs or genomic DNAs obtainable therefrom) or fragments of positional segments of 5' ESTs (or cDNAs or genomic DNAs obtainable therefrom). For example, the antibody may be capable of specifically binding to a polypeptide of one of SEQ ID NOs: 1757-3475, a fragment of a polypeptide of one of SEQ ID NOs: 1757-3475, a positional segment of a polypeptide of one of SEQ ID NOs.: 1757-3475, or a fragment of a positional segment of a polypeptide of one of SEQ ID NOs.: 1757-3475. In some embodiments, the antibody may be capable of binding an antigenic determinant or an epitope in a protein or polypeptide encoded by 5' ESTs (or cDNAs or genomic DNAs obtainable therefrom), fragments of 5' ESTs (or cDNAs or genomic DNAs obtainable therefrom), positional segments of 5' ESTs (or cDNAs or genomic DNAs obtainable therefrom) or fragments of positional segments of 5' ESTs (or cDNAs or genomic DNAs obtainable therefrom) nucleic acids. For example, the antibody may be capable of binding to an antigenic determinant or an epitope in a polypeptide of one of SEQ ID NOs: 1757-3475, a fragment of a polypeptide of one of SEQ ID NOs: 1757-3475, a positional segment of a polypeptide of one of SEQ ID NOs.: 1757-3475, or a fragment of a positional segment of a polypeptide of one of SEQ ID NOs.: 1757-3475.

Antibodies of the present invention may be described or specified in terms of the epitope(s) or portion(s) of a polypeptide of the present invention which are recognized or specifically bound by the antibody.

In the case of secreted proteins, the antibodies may specifically bind a full-length protein encoded by a nucleic acid of the present invention, a mature protein (i.e. the protein generated by cleavage of the signal peptide) encoded by a nucleic acid of the present invention, or a signal peptide encoded by a nucleic acid of the present invention. Moreover, the epitope(s) or polypeptide portion(s) may be specified as described herein, e.g., by N-terminal and C-terminal positions, by size in contiguous amino acid residues, or listed in the Tables and sequence listing. Antibodies which specifically bind any epitope or polypeptide of the present invention may also be excluded. Therefore, the present invention includes antibodies that specifically bind polypeptides of the present invention, and allows for the exclusion of the same.

Antibodies of the present invention may also be described or specified in terms of their cross-reactivity. Antibodies that do not bind any other analog, ortholog, or homolog of the polypeptides of the present invention are included. Antibodies that do not bind polypeptides with less than 95%, less than 90%, less than 85%, less than 80%, less than 75%, less than 70%, less than 65%, less than 60%, less than 55%, and less than 50% identity (as calculated using methods known in the art and described herein) to a polypeptide of the present invention are also included in the present invention. Further included in the present invention are antibodies which only bind polypeptides encoded by polynucleotides which hybridize to a polynucleotide of the present invention under stringent hybridization conditions (as described herein). Antibodies of the present invention may also be described or specified in terms of their binding affinity. Preferred binding affinities include those with a dissociation constant or Kd less than $5\times10^{-6}$M, $10^{-6}$M, $5\times10^{-7}$M, $10^{-7}$M, $5\times10^{-8}$M, $10^{-8}$M, $5\times10^{-9}$M, $10^{-9}$M, $5\times10^{-10}$M, $10^{-10}$M, $5\times10^{-11}$M, $10^{-11}$M, $5\times10^{-12}$M, $10^{-12}$M, $5\times10^{-13}$M, $10^{-13}$M, $5\times10^{-14}$M, $10^{-14}$M, $5\times10^{-15}$M, and $10^{-15}$M.

Antibodies of the present invention have uses that include, but are not limited to, methods known in the art to purify, detect, and target the polypeptides of the present invention including both in vitro and in vivo diagnostic and therapeutic methods. For example, the antibodies have use in immunoassays for qualitatively and quantitatively measuring levels of the polypeptides of the present invention in biological samples. See, e.g., Harlow et al., *ANTIBODIES: A LABORATORY MANUAL*, (Cold Spring Harbor Laboratory Press, 2nd ed. 1988) (incorporated by reference in the entirety).

The antibodies of the present invention may be used either alone or in combination with other compositions. The antibodies may further be recombinantly fused to a heterologous polypeptide at the N- or C-terminus or chemically conjugated (including covalent and non-covalent conjugations) to polypeptides or other compositions. For example, antibodies of the present invention may be recombinantly fused or conjugated to molecules useful as labels in detection assays and effector molecules such as heterologous polypeptides, drugs, or toxins. See, e.g., WO 92/08495; WO 91/14438; WO 89/12624; U.S. Pat. No. 5,314,995; and EP 0 396 387.

The antibodies of the present invention may be prepared by any suitable method known in the art. For example, a polypeptide of the present invention or an antigenic fragment thereof can be administered to an animal in order to induce the production of sera containing polyclonal antibodies. The term "monoclonal antibody" is not limited to antibodies produced through hybridoma technology. The term "antibody" refers to a polypeptide or group of polypeptides which are comprised of at least one binding domain, where a binding domain is formed from the folding of variable domains of an antibody molecule to form three-dimensional binding spaces with an internal surface shape and charge distribution complementary to the features of an antigenic determinant of an antigen, which allows an immunological reaction with the antigen. The term "monoclonal antibody" refers to an antibody that is derived from a single clone, including eukaryotic, prokaryotic, or phage clone, and not the method by which it is produced. Monoclonal antibodies can be prepared using a wide variety of techniques known in the art including the use of hybridoma, recombinant, and phage display technology.

Hybridoma techniques include those known in the art (See, e.g., Harlow et al., ANTIBODIES: A LABORATORY MANUAL, (Cold Spring Harbor Laboratory Press, 2nd ed. 1988); Hammerling, et al., in: MONOCLONAL ANTIBODIES AND T-CELL HYBRIDOMAS 563-681 (Elsevier, N.Y., 1981) (said references incorporated by reference in their entireties). Fab and F(ab')2 fragments may be produced, for example, from hybridoma-produced antibodies by proteolytic cleavage, using enzymes such as papain (to produce Fab fragments) or pepsin (to produce F(ab')2 fragments).

Alternatively, antibodies of the present invention can be produced through the application of recombinant DNA technology or through synthetic chemistry using methods known in the art. For example, the antibodies of the present invention can be prepared using various phage display methods known in the art. In phage display methods, functional antibody domains are displayed on the surface of a phage particle which carries polynucleotide sequences encoding them. Phage with a desired binding property are selected from a repertoire or combinatorial antibody library (e.g. human or murine) by selecting directly with antigen, typically antigen bound or captured to a solid surface or bead. Phage used in these methods are typically filamentous phage including fd and M13 with Fab, Fv or disulfide stabilized Fv antibody domains recombinantly fused to either the phage gene III or gene VIII protein. Examples of phage display methods that can be used to make the antibodies of the present invention include those disclosed in Brinkman U. et al. (1995) J. Immunol. Methods 182:41-50; Ames, R. S. et al. (1995) J. Immunol. Methods 184:177-186; Kettleborough, C. A. et al. (1994) Eur. J. Immunol. 24:952-958; Persic, L. et al. (1997) Gene 187 9-18; Burton, D. R. et al. (1994) Advances in Immunology 57:191-280; PCT/GB91/01134; WO 90/02809; WO 91/10737; WO 92/01047; WO 92/18619; WO 93/11236; WO 95/15982; WO 95/20401; and U.S. Pat. Nos. 5,698,426, 5,223,409, 5,403,484, 5,580,717, 5,427,908, 5,750,753, 5,821,047, 5,571,698, 5,427,908, 5,516,637, 5,780,225, 5,658,727 and 5,733,743 (said references incorporated by reference in their entireties).

As described in the above references, after phage selection, the antibody coding regions from the phage can be isolated and used to generate whole antibodies, including human antibodies, or any other desired antigen binding fragment, and expressed in any desired host including mammalian cells, insect cells, plant cells, yeast, and bacteria. For example, techniques to recombinantly produce Fab, Fab' F(ab)2 and F(ab')2 fragments can also be employed using methods known in the art such as those disclosed in WO 92/22324; Mullinax, R. L. et al. (1992) BioTechniques 12(6):864-869; and Sawai, H. et al. (1995) AJRI 34:26-34; and Better, M. et al. (1988) Science 240:1041-1043 (said references incorporated by reference in their entireties).

Examples of techniques which can be used to produce single-chain Fvs and antibodies include those described in U.S. Pat. Nos. 4,946,778 and 5,258,498; Huston et al. (1991) Methods in Enzymology 203:46-88; Shu, L. et al. (1993) PNAS 90:7995-7999; and Skerra, A. et al. (1988) Science 240:1038-1040. For some uses, including in vivo use of antibodies in humans and in vitro detection assays, it may be preferable to use chimeric, humanized, or human antibodies. Methods for producing chimeric antibodies are known in the art. See e.g., Morrison, Science 229:1202 (1985); Oi et al., BioTechniques 4:214 (1986); Gillies, S. D. et al. (1989) J. Immunol. Methods 125:191-202; and U.S. Pat. No. 5,807,715. Antibodies can be humanized using a variety of techniques including CDR-grafting (EP 0 239 400; WO 91/09967; U.S. Pat. Nos. 5,530,101; and 5,585,089), veneering or resurfacing (EP 0 592 106; EP 0 519 596; Padlan E. A., (1991) Molecular Immunology 28(4/5):489-498; Studnicka G. M. et al. (1994) Protein Engineering 7(6):805-814; Roguska M. A. et al. (1994) PNAS 91:969-973), and chain shuffling (U.S. Pat. No. 5,565,332). Human antibodies can be made by a variety of methods known in the art including phage display methods described above. See also, U.S. Pat. Nos. 4,444,887, 4,716,111, 5,545,806, and 5,814,318; WO 98/46645; WO 98/50433; WO 98/24893; WO 96/34096; WO 96/33735; and WO 91/10741 (said references incorporated by reference in their entireties).

Further included in the present invention are antibodies recombinantly fused or chemically conjugated (including both covalently and non-covalently conjugations) to a polypeptide of the present invention. The antibodies may be specific for antigens other than polypeptides of the present invention. For example, antibodies may be used to target the polypeptides of the present invention to particular cell types, either in vitro or in vivo, by fusing or conjugating the polypeptides of the present invention to antibodies specific for particular cell surface receptors. Antibodies fused or conjugated to the polypeptides of the present invention may also be used in in vitro immunoassays and purification methods using methods known in the art. See e.g., Harbor et al. supra and WO 93/21232; EP 0 439 095; Naramura, M. et al. (1994) Immunol. Lett. 39:91-99; U.S. Pat. No. 5,474,981; Gillies, S. O. et al. (1992) PNAS 89:1428-1432; Fell, H. P. et al. (1991) J. Immunol. 146:2446-2452 (said references incorporated by reference in their entireties).

The present invention further includes compositions comprising the polypeptides of the present invention fused or conjugated to antibody domains other than the variable regions. For example, the polypeptides of the present invention may be fused or conjugated to an antibody Fc region, or portion thereof. The antibody portion fused to a polypeptide of the present invention may comprise the hinge region, CH1 domain, CH2 domain, and CH3 domain or any combination of whole domains or portions thereof. The polypeptides of the present invention may be fused or conjugated to the above antibody portions to increase the in vivo half life of the polypeptides or for use in immunoassays using methods known in the art. The polypeptides may also be fused or conjugated to the above antibody portions to form multimers. For example, Fc portions fused to the polypeptides of the present invention can form dimers through disulfide bonding between the Fc portions. Higher multimeric forms can be made by fusing the polypeptides to portions of IgA and IgM. Methods for fusing or conjugating the polypeptides of the present invention to antibody portions are known in the art. See e.g., U.S. Pat. Nos. 5,336,603, 5,622,929, 5,359,046, 5,349,053, 5,447,851, 5,112,946; EP 0 307 434, EP 0 367 166; WO 96/04388, WO 91/06570; Ashkenazi, A. et al. (1991) PNAS 88:10535-10539; Zheng, X. X. et al. (1995) J. Immunol. 154:5590-5600; and Vil, H. et al. (1992) PNAS 89:11337-11341 (said references incorporated by reference in their entireties).

The invention further relates to antibodies which act as agonists or antagonists of the polypeptides of the present invention. For example, the present invention includes antibodies which disrupt the receptor/ligand interactions with the polypeptides of the invention either partially or fully. Included are both receptor-specific antibodies and ligand-specific antibodies. Included are receptor-specific antibodies which do not prevent ligand binding but prevent receptor activation. Receptor activation (i.e., signaling) may be determined by techniques described herein or otherwise known in the art. Also include are receptor-specific antibodies which both prevent ligand binding and receptor activation. Likewise, included are neutralizing antibodies which bind the ligand and prevent binding of the ligand to the receptor, as well as antibodies which bind the ligand, thereby preventing receptor activation, but do not prevent the ligand from binding the receptor. Further included are antibodies which activate the receptor. These antibodies may act as agonists for either all or less than all of the biological activities affected by ligand-mediated receptor activation. The antibodies may be specified as agonists or antagonists for biological activities comprising specific activities disclosed herein. The above antibody agonists can be made using methods known in the art. See e.g., WO 96/40281; U.S. Pat. No. 5,811,097; Deng, B. et al. (1998) Blood 92(6):1981-1988; Chen, Z. et al. (1998) Cancer Res. 58(16):3668-3678; Harrop, J. A. et al. (1998) J. Immunol. 161(4):1786-1794; Zhu, Z. et al. (1998) Cancer Res. 58(15):3209-3214; Yoon, D. Y. et al. (1998) J. Immunol. 160(7):3170-3179; Prat, M. et al. (1998) J. Cell. Sci. 111 (Pt2):237-247; Pitard, V. et al. (1997) J. Immunol. Methods 205(2):177-190; Liautard, J. et al. (1997) Cytokinde 9(4): 233-241; Carlson, N. G. et al. (1997) J. Biol. Chem. 272(17): 11295-11301; Taryman, R. E. et al. (1995) Neuron 14(4):755-762; Muller, Y. A. et al. (1998) Structure 6(9):1153-1167; Bartunek, P. et al. (1996) Cytokine 8(1):14-20 (said references incorporated by reference in their entireties).

As discussed above, antibodies of the polypeptides of the invention can, in turn, be utilized to generate anti-idiotypic antibodies that "mimic" polypeptides of the invention using techniques well known to those skilled in the art. See, e.g. Greenspan and Bona, FASEB J. 7(5):437-444 (1989); Nissinoff, J. Immunol. 147(8):2429-2438 (1991). For example, antibodies which bind to and competitively inhibit polypeptide multimerization or binding of a polypeptide of the invention to ligand can be used to generate anti-idiotypes that "mimic" the polypeptide multimerization or binding domain and, as a consequence, bind to and neutralize polypeptide or its ligand. Such neutralization anti-idiotypic antibodies can be used to bind a polypeptide of the invention or to bind its ligands/receptors, and therby block its biological activity,

EXAMPLE 40

Production of an Antibody to a Human Protein

Substantially pure protein or polypeptide is isolated from the transfected or transformed cells as described in Example 30. The concentration of protein in the final preparation is adjusted, for example, by concentration on an Amicon filter device, to the level of a few micrograms/ml. Monoclonal or polyclonal antibody to the protein can then be prepared as follows:

A. Monoclonal Antibody Production by Hybridoma Fusion

Monoclonal antibody to epitopes of any of the peptides identified and isolated as described can be prepared from murine hybridomas according to the classical method of Kohler, G. and Milstein, C., Nature 256:495 (1975) or derivative methods thereof. Briefly, a mouse is repetitively inoculated with a few micrograms of the selected protein or peptides derived therefrom over a period of a few weeks. The mouse is then sacrificed, and the antibody producing cells of the spleen isolated. The spleen cells are fused by means of polyethylene glycol with mouse myeloma cells, and the excess unfused cells destroyed by growth of the system on selective media comprising aminopterin (HAT media). The successfully fused cells are diluted and aliquots of the dilution placed in wells of a microtiter plate where growth of the culture is continued. Antibody-producing clones are identified by detection of antibody in the supernatant fluid of the wells by immunoassay procedures, such as Elisa, as originally described by Engvall, E., Meth. Enzymol. 70:419 (1980), and derivative methods thereof. Selected positive clones can be expanded and their monoclonal antibody product harvested for use. Detailed procedures for monoclonal antibody production are described in Davis, L. et al. Basic Methods in Molecular Biology Elsevier, New York. Section 21-2.

B. Polyclonal Antibody Production by Immunization

Polyclonal antiserum containing antibodies to heterogenous epitopes of a single protein can be prepared by immunizing suitable animals with the expressed protein or peptides derived therefrom described above, which can be unmodified or modified to enhance immunogenicity. Effective polyclonal antibody production is affected by many factors related both to the antigen and the host species. For example, small molecules tend to be less immunogenic than others and may require the use of carriers and adjuvant. Also, host animals vary in response to site of inoculations and dose, with both inadequate or excessive doses of antigen resulting in low titer antisera. Small doses (ng level) of antigen administered at multiple intradermal sites appears to be most reliable. An effective immunization protocol for rabbits can be found in Vaitukaitis, J. et al. J. Clin. Endocrinol. Metab. 33:988-991 (1971).

Booster injections can be given at regular intervals, and antiserum harvested when antibody titer thereof, as determined semi-quantitatively, for example, by double immunodiffusion in agar against known concentrations of the antigen, begins to fall. See, for example, Ouchterlony, O. et al., Chap. 19 in: Handbook of Experimental Immunology D. Wier (ed) Blackwell (1973). Plateau concentration of antibody is usually in the range of 0.1 to 0.2 mg/ml of serum (about 12 µM). Affinity of the antisera for the antigen is determined by preparing competitive binding curves, as described, for example, by Fisher, D., Chap. 42 in: Manual of Clinical Immunology, 2d Ed. (Rose and Friedman, Eds.) Amer. Soc. For Microbiol., Washington, D.C. (1980).

Antibody preparations prepared according to either protocol are useful in quantitative immunoassays which determine concentrations of antigen-bearing substances in biological samples; they are also used semi-quantitatively or qualitatively to identify the presence of antigen in a biological sample. The antibodies may also be used in therapeutic compositions for killing cells expressing the protein or reducing the levels of the protein in the body.

V. Use of 5' ESTs or Sequences Obtainable therefrom as Reagents

The 5' ESTs of the present invention (or cDNAs or genomic DNAs obtainable therefrom) therefrom may be used as reagents in isolation procedures, diagnostic assays, and forensic procedures. For example, sequences from the 5' ESTs (or cDNAs or genomic DNAs obtainable therefrom), may be detectably labeled and used as probes to isolate other sequences capable of hybridizing to them. In addition, sequences from the 5' ESTs (or cDNAs or genomic DNAs obtainable therefrom), may be used to design PCR primers to be used in isolation, diagnostic, or forensic procedures.

EXAMPLE 41

Preparation of PCR Primers and Amplification of DNA

The 5' EST sequences (or cDNAs or genomic DNAs obtainable therefrom) may be used to prepare PCR primers for a variety of applications, including isolation procedures for cloning nucleic acids capable of hybridizing to such sequences, diagnostic techniques and forensic techniques. In some embodiments, the PCR primers may be used to amplify a sequence encoding all or a portion of a secreted polypeptide from a genomic library, such as genomic libraries generated by the U.S. Human Genome Project or other public and private genome sequencing projects.

The PCR primers may be at least 10, 15, 20, 25, 30, 35, or 40 bases in length. In some embodiments, the PCR primers may be more than 40 bases in length. It is preferred that the primer pairs have approximately the same G/C ratio, so that melting temperatures are approximately the same. A variety of PCR techniques are familiar to those skilled in the art. For a review of PCR technology, see Molecular Cloning to Genetic Engineering White, B. A. Ed. in Methods in Molecular Biology 67: Humana Press, Totowa 1997. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites.

EXAMPLE 42

Use of 5' ESTs or Nucleic Acids Obtainable therefrom as Probes

Probes derived from 5' ESTs (or cDNAs or genomic DNAs obtainable therefrom), including full length cDNAs or genomic sequences, may be labeled with detectable labels familiar to those skilled in the art, including radioisotopes and non-radioactive labels, to provide a detectable probe. The detectable probe may be single stranded or double stranded and may be made using techniques known in the art, including in vitro transcription, nick translation, or kinase reactions.

A nucleic acid sample containing a sequence capable of hybridizing to the labeled probe is contacted with the labeled probe. If the nucleic acid in the sample is double stranded, it may be denatured prior to contacting the probe. In some applications, the nucleic acid sample may be immobilized on a surface such as a nitrocellulose or nylon membrane. The nucleic acid sample may comprise nucleic acids obtained from a variety of sources, including genomic DNA, cDNA libraries, RNA, or tissue samples.

Procedures used to detect the presence of nucleic acids capable of hybridizing to the detectable probe include well known techniques such as Southern blotting, Northern blotting, dot blotting, colony hybridization, and plaque hybridization. In some applications, the nucleic acid capable of hybridizing to the labeled probe may be cloned into vectors such as expression vectors, sequencing vectors, or in vitro transcription vectors to facilitate the characterization and expression of the hybridizing nucleic acids in the sample. For example, such techniques may be used to isolate and clone sequences in a genomic library or cDNA library which are capable of hybridizing to the detectable probe as described above.

In some embodiments, the detectable probes may be used to identify clones in a genomic DNA library which include sequences encoding all or part of a secreted protein. For example, the genomic library may be a genomic library generated by the U.S. Human Genome Project or other public and private genome sequencing projects.

PCR primers made as described in Example 41 above may be used in forensic analyses, such as the DNA fingerprinting techniques described in Examples 43-47 below. Such analyses may utilize detectable probes or primers based on the sequences of the 5' ESTs or of cDNAs or genomic DNAs isolated using the 5' ESTs.

EXAMPLE 43

Forensic Matching by DNA Sequencing

In one exemplary method, DNA samples are isolated from forensic specimens of, for example, hair, semen, blood or skin cells by conventional methods. A panel of PCR primers based on a number of the 5' ESTs, or cDNAs or genomic DNAs isolated therefrom as described above, is then utilized in accordance with Example 41 to amplify DNA of approximately 100-200 bases in length from the forensic specimen. Corresponding sequences are obtained from a test subject. Each of these identification DNAs is then sequenced using standard techniques, and a simple database comparison determines the differences, if any, between the sequences from the subject and those from the sample. Statistically significant differences between the suspect's DNA sequences and those from the sample conclusively prove a lack of identity. This lack of identity can be proven, for example, with only one sequence. Identity, on the other hand, should be demonstrated with a large number of sequences, all matching. Preferably, a minimum of 50 statistically identical sequences of 100 bases in length are used to prove identity between the suspect and the sample.

EXAMPLE 44

Positive Identification by DNA Sequencing

The technique outlined in the previous example may also be used on a larger scale to provide a unique fingerprint-type identification of any individual. In this technique, primers are prepared from a large number of sequences from Example 25, or cDNA or genomic DNA sequences obtainable therefrom. Preferably, 20 to 50 different primers are used. These primers are used to obtain a corresponding number of PCR-generated DNA segments from the individual in question in accordance with Example 41. Each of these DNA segments is sequenced, using the methods set forth in Example 43. The database of sequences generated through this procedure uniquely identifies the individual from whom the sequences were obtained. The same panel of primers may then be used at any later time to absolutely correlate tissue or other biological specimen with that individual.

EXAMPLE 45

Southern Blot Forensic Identification

The procedure of Example 44 is repeated to obtain a panel of at least 10 amplified sequences from an individual and a specimen. Preferably, the panel contains at least 50 amplified sequences. More preferably, the panel contains 100 amplified sequences. In some embodiments, the panel contains 200 amplified sequences. This PCR-generated DNA is then digested with one or a combination of, preferably, four base specific restriction enzymes. Such enzymes are commercially available and known to those of skill in the art. After digestion, the resultant gene fragments are size separated in multiple duplicate wells on an agarose gel and transferred to nitrocellulose using Southern blotting techniques well known to those with skill in the art. For a review of Southern blotting see Davis et al. (*Basic Methods in Molecular Biology,* 1986, Elsevier Press. pp 62-65).

A panel of probes based on the sequences of the 5' ESTs (or cDNAs or genomic DNAs obtainable therefrom), or fragments thereof of at least 8, 10, 12, 15, 20, 23, 25, 28, 30, 35, 40, 50, 75, 100, 200, 300, 500, or 1000 bases, are radioactively or colorimetrically labeled using methods known in the art, such as nick translation or end labeling, and hybridized to the Southern blot using techniques known in the art (Davis et al., supra).

Preferably, at least 5 to 10 of these labeled probes are used, and more preferably at least about 20 or 30 are used to provide a unique pattern. The resultant bands appearing from the hybridization of a large sample of 5' ESTs (or cDNAs or genomic DNAs obtainable therefrom) will be a unique identifier. Since the restriction enzyme cleavage will be different for every individual, the band pattern on the Southern blot will also be unique. Increasing the number of probes derived from 5' ESTs (or cDNAs or genomic DNAs obtainable therefrom) will provide a statistically higher level of confidence in the identification since there will be an increased number of sets of bands used for identification.

EXAMPLE 46

Dot Blot Identification Procedure

Another technique for identifying individuals using the 5' EST sequences disclosed herein utilizes a dot blot hybridization technique.

Genomic DNA is isolated from nuclei of subject to be identified. Oligonucleotide probes of approximately 30 bp in length are synthesized that correspond to at least 10, preferably 50 sequences from the 5' ESTs or cDNAs or genomic DNAs obtainable therefrom. The probes are used to hybridize to the genomic DNA through conditions known to those in the art. The oligonucleotides are end labeled with $P^{32}$ using polynucleotide kinase (Pharmacia). Dot Blots are created by spotting the genomic DNA onto nitrocellulose or the like using a vacuum dot blot manifold (BioRad, Richmond Calif.). The nitrocellulose filter containing the genomic sequences is baked or UV linked to the filter, prehybridized and hybridized with labeled probe using techniques known in the art (Davis et al. supra). The $^{32}P$ labeled DNA fragments are sequentially hybridized with successively stringent conditions to detect minimal differences between the 30 bp sequence and the DNA. Tetramethylammonium chloride is useful for identifying clones containing small numbers of nucleotide mismatches (Wood et al., Proc. Natl. Acad. Sci. USA 82(6):1585-1588 (1985)) which is hereby incorporated by reference. A unique pattern of dots distinguishes one individual from another individual.

5' EST sequences (or cDNAs or genomic DNAs obtainable therefrom) or oligonucleotides containing at least 10, 15, 20, 25, 30, 35, or 40 consecutive bases from these sequences can be used as probes in the following alternative fingerprinting technique.

Preferably, a plurality of probes having sequences from different genes are used in the alternative fingerprinting technique. Example 47 below provides a representative alternative fingerprinting procedure in which the probes are derived from 5' ESTs. However, those skilled in the art will appreciate that the procedure of Example 47 may readily be implemented with probes containing sequences from cDNAs or genomic sequences obtainable from the 5' ESTs.

EXAMPLE 47

Alternative "Fingerprint" Identification Technique 20-mer oligonucleotides are prepared from a large number, e.g. 50, 100, or 200, 5' EST sequences using commercially available oligonucleotide services such as Genset, Paris, France. Cell samples from the test subject are processed for DNA using techniques well known to those with skill in the art. The nucleic acid is digested with restriction enzymes such as EcoRI and XbaI. Following digestion, samples are applied to wells for electrophoresis. The procedure, as known in the art, may be modified to accommodate polyacrylamide electrophoresis, however in this example, samples containing 5 ug of DNA are loaded into wells and separated on 0.8% agarose gels. The gels are transferred onto nitrocellulose using standard Southern blotting techniques.

10 ng of each of the oligonucleotides are pooled and end-labeled with $P^{32}$. The nitrocellulose is prehybridized with blocking solution and hybridized with the labeled probes. Following hybridization and washing, the nitrocellulose filter is exposed to X-Omat AR X-ray film. The resulting hybridization pattern will be unique for each individual.

It is additionally contemplated within this example that the number of probe sequences used can be varied for additional accuracy or clarity.

The antibodies generated in Examples 30 and 40 above may be used to identify the tissue type or cell species from which a sample is derived as described above.

EXAMPLE 48

Identification of Tissue Types or Cell Species by Means of Labeled Tissue Specific Antibodies Identification of specific tissues is accomplished by the visualization of tissue specific antigens by means of antibody preparations according to Examples 30 and 40 which are conjugated, directly or indirectly to a detectable marker. Selected labeled antibody species bind to their specific antigen binding partner in tissue sections, cell suspensions, or in extracts of soluble proteins from a tissue sample to provide a pattern for qualitative or semi-qualitative interpretation.

Antisera for these procedures must have a potency exceeding that of the native preparation, and for that reason, antibodies are concentrated to a mg/ml level by isolation of the gamma globulin fraction, for example, by ion-exchange chromatography or by ammonium sulfate fractionation. Also, to provide the most specific antisera, unwanted antibodies, for example to common proteins, must be removed from the gamma globulin fraction, for example by means of insoluble immunoabsorbents, before the antibodies are labeled with the marker. Either monoclonal or heterologous antisera is suitable for either procedure.

A. Immunohistochemical Techniques

Purified, high-titer antibodies, prepared as described above, are conjugated to a detectable marker, as described, for example, by Fudenberg, H., Chap. 26 in: Basic 503 Clinical Immunology, 3rd Ed. Lange, Los Altos, Calif. (1980) or Rose, N. et al., Chap. 12 in: Methods in Immunodiagnosis, 2d Ed. John Wiley 503 Sons, New York (1980).

A fluorescent marker, either fluorescein or rhodamine, is preferred, but antibodies can also be labeled with an enzyme that supports a color producing reaction with a substrate, such as horseradish peroxidase. Markers can be added to tissue-bound antibody in a second step, as described below. Alternatively, the specific antitissue antibodies can be labeled with ferritin or other electron dense particles, and localization of the ferritin coupled antigen-antibody complexes achieved by means of an electron microscope. In yet another approach, the antibodies are radiolabeled, with, for example $^{125}I$, and detected by overlaying the antibody treated preparation with photographic emulsion.

Preparations to carry out the procedures can comprise monoclonal or polyclonal antibodies to a single protein or peptide identified as specific to a tissue type, for example, brain tissue, or antibody preparations to several antigenically distinct tissue specific antigens can be used in panels, independently or in mixtures, as required.

Tissue sections and cell suspensions are prepared for immunohistochemical examination according to common histological techniques. Multiple cryostat sections (about 4 μm, unfixed) of the unknown tissue and known control, are mounted and each slide covered with different dilutions of the antibody preparation. Sections of known and unknown tissues should also be treated with preparations to provide a positive control, a negative control, for example, pre-immune sera, and a control for non-specific staining, for example, buffer.

Treated sections are incubated in a humid chamber for 30 min at room temperature, rinsed, then washed in buffer for 30-45 min. Excess fluid is blotted away, and the marker developed.

If the tissue specific antibody was not labeled in the first incubation, it can be labeled at this time in a second antibody-antibody reaction, for example, by adding antiserum-producing species, for example, fluorescein labeled antibody to mouse IgG. Such labeled sera are commercially available.

The antigen found in the tissues by the above procedure can be quantified by measuring the intensity of color or fluorescence on the tissue section, and calibrating that signal using appropriate standards.

B. Identification of Tissue Specific Soluble Proteins

The visualization of tissue specific proteins and identification of unknown tissues from that procedure is carried out using the labeled antibody reagents and detection strategy as described for immunohistochemistry; however the sample is prepared according to an electrophoretic technique to distribute the proteins extracted from the tissue in an orderly array on the basis of molecular weight for detection.

A tissue sample is homogenized using a Virtis apparatus; cell suspensions are disrupted by Dounce homogenization or osmotic lysis, using detergents in either case as required to disrupt cell membranes, as is the practice in the art. Insoluble cell components such as nuclei, microsomes, and membrane fragments are removed by ultracentrifugation, and the soluble protein-containing fraction concentrated if necessary and reserved for analysis.

A sample of the soluble protein solution is resolved into individual protein species by conventional SDS polyacrylamide electrophoresis as described, for example, by Davis, L. et al., Section 19-2 in: Basic Methods in Molecular Biology (P. Leder, ed), Elsevier, New York (1986), using a range of amounts of polyacrylamide in a set of gels to resolve the entire molecular weight range of proteins to be detected in the sample. A size marker is run in parallel for purposes of estimating molecular weights of the constituent proteins. Sample size for analysis is a convenient volume of from 5 to 55 μl, and containing from about 1 to 100 μg protein. An aliquot of each of the resolved proteins is transferred by blotting to a nitrocellulose filter paper, a process that maintains the pattern of resolution. Multiple copies are prepared. The procedure, known as Western Blot Analysis, is well described in Davis, L. et al., (above) Section 19-3. One set of nitrocellulose blots is stained with Coomassie Blue dye to visualize the entire set of proteins for comparison with the antibody bound proteins. The remaining nitrocellulose filters are then incubated with a solution of one or more specific antisera to tissue specific proteins prepared as described in Examples 30 and 40. In this procedure, as in procedure A above, appropriate positive and negative sample and reagent controls are run.

In either procedure A or B, a detectable label can be attached to the primary tissue antigen-primary antibody complex according to various strategies and permutations thereof. In a straightforward approach, the primary specific antibody can be labeled; alternatively, the unlabeled complex can be bound by a labeled secondary anti-IgG antibody. In other approaches, either the primary or secondary antibody is conjugated to a biotin molecule, which can, in a subsequent step, bind an avidin conjugated marker. According to yet another strategy, enzyme labeled or radioactive protein A, which has the property of binding to any IgG, is bound in a final step to either the primary or secondary antibody.

The visualization of tissue specific antigen binding at levels above those seen in control tissues to one or more tissue specific antibodies, prepared from the gene sequences identified from EST sequences, can identify tissues of unknown origin, for example, forensic samples, or differentiated tumor tissue that has metastasized to foreign bodily sites.

In addition to their applications in forensics and identification, 5' ESTs (or cDNAs or genomic DNAs obtainable therefrom) may be mapped to their chromosomal locations. Example 49 below describes radiation hybrid (RH) mapping of human chromosomal regions using 5' ESTs. Example 50 below describes a representative procedure for mapping a 5' EST to its location on a human chromosome. Example 51 below describes mapping of 5' ESTs on metaphase chromosomes by Fluorescence In Situ Hybridization (FISH). Those skilled in the art will appreciate that the method of Examples 49-51 may also be used to map cDNAs or genomic DNAs obtainable from the 5' ESTs to their chromosomal locations.

EXAMPLE 49

Radiation Hybrid Mapping of 5' ESTs to the Human Genome

Radiation hybrid (RH) mapping is a somatic cell genetic approach that can be used for high resolution mapping of the human genome. In this approach, cell lines containing one or more human chromosomes are lethally irradiated, breaking each chromosome into fragments whose size depends on the radiation dose. These fragments are rescued by fusion with cultured rodent cells, yielding subclones containing different portions of the human genome. This technique is described by Benham et al. (*Genomics* 4:509-517, 1989) and Cox et al., (*Science* 250:245-250, 1990), the entire contents of which are hereby incorporated by reference. The random and independent nature of the subclones permits efficient mapping of any human genome marker. Human DNA isolated from a panel of 80-100 cell lines provides a mapping reagent for ordering 5' ESTs. In this approach, the frequency of breakage between markers is used to measure distance, allowing construction of fine resolution maps as has been done using conventional ESTs (Schuler et al., *Science* 274:540-546, 1996, hereby incorporated by reference).

RH mapping has been used to generate a high-resolution whole genome radiation hybrid map of human chromosome 17q22-q25.3 across the genes for growth hormone (GH) and thymidine kinase (TK) (Foster et al., *Genomics* 33:185-192, 1996), the region surrounding the Gorlin syndrome gene (Obermayr et al., *Eur. J Hum. Genet.* 4:242-245, 1996), 60 loci covering the entire short arm of chromosome 12 (Raeymaekers et al., *Genomics* 29:170-178, 1995), the region of human chromosome 22 containing the neurofibromatosis type 2 locus (Frazer et al., *Genomics* 14:574-584, 1992) and 13 loci on the long arm of chromosome 5 (Warrington et al., *Genomics* 11:701-708, 1991).

EXAMPLE 50

Mapping of 5' ESTs to Human Chromosomes Using PCR Techniques

5' ESTs (or cDNAs or genomic DNAs obtainable therefrom) may be assigned to human chromosomes using PCR based methodologies. In such approaches, oligonucleotide primer pairs are designed from sequences in the 5' ESTs (or cDNAs or genomic DNAs obtainable therefrom) to minimize the chance of amplifying through an intron. Preferably, the oligonucleotide primers are 18-23 bp in length and are designed for PCR amplification. The creation of PCR primers from known sequences is well known to those with skill in the art. For a review of PCR technology see Erlich, H. A., *PCR Technology; Principles and Applications for DNA Amplification.* 1992. W.H. Freeman and Co., New York.

The primers are used in polymerase chain reactions (PCR) to amplify templates from total human genomic DNA. PCR conditions are as follows: 60 ng of genomic DNA is used as a template for PCR with 80 ng of each oligonucleotide primer, 0.6 unit of Taq polymerase, and 1 μCu of a $^{32}$P-labeled deoxycytidine triphosphate. The PCR is performed in a microplate thermocycler (Techne) under the following conditions: 30 cycles of 94° C., 1.4 min; 55° C., 2 min; and 72° C., 2 min; with a final extension at 72° C. for 10 min. The amplified products are analyzed on a 6% polyacrylamide sequencing gel and visualized by autoradiography. If the length of the resulting PCR product is identical to the distance between the ends of the primer sequences in the 5' ESTs (or cDNAs or genomic DNAs obtainable therefrom) from which the primers are derived, then the PCR reaction is repeated with DNA templates from two panels of human-rodent somatic cell hybrids, BIOS PCRable DNA (BIOS Corporation) and NIGMS Human-Rodent Somatic Cell Hybrid Mapping Panel Number 1 (NIGMS, Camden, N.J.).

PCR is used to screen a series of somatic cell hybrid cell lines containing defined sets of human chromosomes for the presence of a given 5' EST (or cDNA or genomic DNA obtainable therefrom). DNA is isolated from the somatic hybrids and used as starting templates for PCR reactions using the primer pairs from the 5' ESTs (or cDNAs or genomic DNAs obtainable therefrom). Only those somatic cell hybrids with chromosomes containing the human gene corresponding to the 5' EST (or cDNA or genomic DNA obtainable therefrom) will yield an amplified fragment. The 5' ESTs are assigned to a chromosome by analysis of the segregation pattern of PCR products from the somatic hybrid DNA templates. The single human chromosome present in all cell hybrids that give rise to an amplified fragment is the chromosome containing that 5' EST (or cDNA or genomic DNA obtainable therefrom). For a review of techniques and analysis of results from somatic cell gene mapping experiments. (See Ledbetter et al., Genomics 6:475-481 (1990).)

Alternatively, the 5' ESTs (or cDNAs or genomic DNAs obtainable therefrom) may be mapped to individual chromosomes using FISH as described in Example 51 below.

EXAMPLE 51

Mapping of 5' ESTs to Chromosomes using Fluorescence In Situ Hybridization

Fluorescence in situ hybridization allows the 5' EST (or cDNAs or genomic DNAs obtainable therefrom) to be mapped to a particular location on a given chromosome. The chromosomes to be used for fluorescence in situ hybridization techniques may be obtained from a variety of sources including cell cultures, tissues, or whole blood.

In a preferred embodiment, chromosomal localization of a 5' EST (or cDNA or genomic DNAs obtained therefrom) are obtained by FISH as described by Cherif et al. (*Proc. Natl. Acad Sci. U.S.A.*, 87:6639-6643, 1990). Metaphase chromosomes are prepared from phytohemagglutinin (PHA)-stimulated blood cell donors. PHA-stimulated lymphocytes from healthy males are cultured for 72 h in RPMI-1640 medium. For synchronization, methotrexate (10 µM) is added for 17 h, followed by addition of 5-bromodeoxyuridine (5-BudR, 0.1 mM) for 6 h. Colcemid (1 µg/ml) is added for the last 15 min before harvesting the cells. Cells are collected, washed in RPMI, incubated with a hypotonic solution of KCl (75 mM) at 37° C. for 15 min and fixed in three changes of methanol: acetic acid (3:1). The cell suspension is dropped onto a glass slide and air dried. The 5' EST (or cDNA or genomic DNA obtainable therefrom) is labeled with biotin-16 dUTP by nick translation according to the manufacturer's instructions (Bethesda Research Laboratories, Bethesda, Md.), purified using a Sephadex G-50 column (Pharmacia, Upssala, Sweden) and precipitated. Just prior to hybridization, the DNA pellet is dissolved in hybridization buffer (50% formamide, 2×SSC, 10% dextran sulfate, 1 mg/ml sonicated salmon sperm DNA, pH 7) and the probe is denatured at 70° C. for 5-10 min.

Slides kept at −20° C. are treated for 1 h at 37° C. with RNase A (100 µg/ml), rinsed three times in 2×SSC and dehydrated in an ethanol series. Chromosome preparations are denatured in 70% formamide, 2×SSC for 2 min at 70° C., then dehydrated at 4° C. The slides are treated with proteinase K (10 µg/100 ml in 20 mM Tris-HCl, 2 mM $CaCl_2$) at 37° C. for 8 min and dehydrated. The hybridization mixture containing the probe is placed on the slide, covered with a coverslip, sealed with rubber cement and incubated overnight in a humid chamber at 37° C. After hybridization and post-hybridization washes, the biotinylated probe is detected by avidin-FITC and amplified with additional layers of biotinylated goat anti-avidin and avidin-FITC. For chromosomal localization, fluorescent R-bands are obtained as previously described (Cherif et al., supra.). The slides are observed under a LEICA fluorescence microscope (DMRXA). Chromosomes are counterstained with propidium iodide and the fluorescent signal of the probe appears as two symmetrical yellow-green spots on both chromatids of the fluorescent R-band chromosome (red). Thus, a particular 5' EST (or cDNA or genomic DNA obtainable therefrom) may be localized to a particular cytogenetic R-band on a given chromosome.

Once the 5' ESTs (or cDNAs or genomic DNAs obtainable therefrom) have been assigned to particular chromosomes using the techniques described in Examples 49-51 above, they may be utilized to construct a high resolution map of the chromosomes on which they are located or to identify the chromosomes in a sample.

EXAMPLE 52

Use of 5' ESTs to Construct or Expand Chromosome Maps

Chromosome mapping involves assigning a given unique sequence to a particular chromosome as described above. Once the unique sequence has been mapped to a given chromosome, it is ordered relative to other unique sequences located on the same chromosome. One approach to chromosome mapping utilizes a series of yeast artificial chromosomes (YACs) bearing several thousand long inserts derived from the chromosomes of the organism from which the 5' ESTs (or cDNAs or genomic DNAs obtainable therefrom) are obtained. This approach is described in Ranaiah Nagaraja et al. Genome Research 7:210-222, March 1997. Briefly, in this approach each chromosome is broken into overlapping pieces which are inserted into the YAC vector. The YAC inserts are screened using PCR or other methods to determine whether they include the 5' EST (or cDNA or genomic DNA obtainable therefrom) whose position is to be determined. Once an insert has been found which includes the 5' EST (or cDNA or genomic DNA obtainable therefrom), the insert can be analyzed by PCR or other methods to determine whether the insert also contains other sequences known to be on the chromosome or in the region from which the 5' EST (or cDNA or genomic DNA obtainable therefrom) was derived. This process can be repeated for each insert in the YAC library to determine the location of each of the 5' ESTs (or cDNAs or genomic DNAs obtainable therefrom) relative to one another and to other known chromosomal markers. In this way, a high resolution map of the distribution of numerous unique markers along each of the organisms chromosomes may be obtained.

As described in Example 53 below 5' ESTs (or cDNAs or genomic DNAs obtainable therefrom) may also be used to identify genes associated with a particular phenotype, such as hereditary disease or drug response.

EXAMPLE 53

Identification of Genes Associated with Hereditary Diseases or Drug Response This example illustrates an approach useful for the association of 5' EST sequences (or cDNAs or genomic DNAs obtainable therefrom) with particular phenotypic characteristics. In this example, a particular 5' EST (or cDNAs or genomic DNAs obtainable therefrom) is used as a test probe to associate that 5' EST (or cDNAs or genomic DNAs obtainable therefrom) with a particular phenotypic characteristic.

5' ESTs (or cDNAs or genomic DNAs obtainable therefrom) are mapped to a particular location on a human chromosome using techniques such as those described in Examples 49 and 50 or other techniques known in the art. A search of Mendelian Inheritance in Man (V. McKusick, Mendelian Inheritance in Man (available on line through Johns Hopkins University Welch Medical Library) reveals the region of the human chromosome which contains the 5' EST (or cDNAs or genomic DNAs obtainable therefrom) to be a very gene rich region containing several known genes and several diseases or phenotypes for which genes have not been identified. The gene corresponding to this 5' EST (or cDNAs or genomic DNAs obtainable therefrom) thus becomes an immediate candidate for each of these genetic diseases.

Cells from patients with these diseases or phenotypes are isolated and expanded in culture. PCR primers from the 5'

EST sequences (or cDNAs or genomic DNAs obtainable therefrom) are used to screen genomic DNA, mRNA or cDNA obtained from the patients. 5' ESTs (or cDNAs or genomic DNAs obtainable therefrom) that are not amplified in the patients can be positively associated with a particular disease by further analysis. Alternatively, the PCR analysis may yield fragments of different lengths when the samples are derived from an individual having the phenotype associated with the disease than when the sample is derived from a healthy individual, indicating that the gene containing the 5' EST may be responsible for the genetic disease.

VI. Use of 5' ESTs (or cDNAs or Genomic DNAs Obtainable therefrom) to Construct Vectors The present 5' ESTs (or cDNAs or genomic DNAs obtainable therefrom) may also be used to construct secretion vectors capable of directing the secretion of the proteins encoded by genes inserted in the vectors. Such secretion vectors may facilitate the purification or enrichment of the proteins encoded by genes inserted therein by reducing the number of background proteins from which the desired protein must be purified or enriched. Exemplary secretion vectors are described in Example 54 below.

EXAMPLE 54

Construction of Secretion Vectors

The secretion vectors of the present invention include a promoter capable of directing gene expression in the host cell, tissue, or organism of interest. Such promoters include the Rous Sarcoma Virus promoter, the SV40 promoter, the human cytomegalovirus promoter, and other promoters familiar to those skilled in the art.

A signal sequence from a 5' EST (or cDNAs or genomic DNAs obtainable therefrom) is operably linked to the promoter such that the mRNA transcribed from the promoter will direct the translation of the signal peptide. The host cell, tissue, or organism may be any cell, tissue, or organism which recognizes the signal peptide encoded by the signal sequence in the 5' EST (or cDNAs or genomic DNAs obtainable therefrom). Suitable hosts include mammalian cells, tissues or organisms, avian cells, tissues, or organisms, insect cells, tissues or organisms, or yeast.

In addition, the secretion vector contains cloning sites for inserting genes encoding the proteins which are to be secreted. The cloning sites facilitate the cloning of the insert gene in frame with the signal sequence such that a fusion protein in which the signal peptide is fused to the protein encoded by the inserted gene is expressed from the mRNA transcribed from the promoter. The signal peptide directs the extracellular secretion of the fusion protein.

The secretion vector may be DNA or RNA and may integrate into the chromosome of the host, be stably maintained as an extrachromosomal replicon in the host, be an artificial chromosome, or be transiently present in the host. Many nucleic acid backbones suitable for use as secretion vectors are known to those skilled in the art, including retroviral vectors, SV40 vectors, Bovine Papilloma Virus vectors, yeast integrating plasmids, yeast episomal plasmids, yeast artificial chromosomes, human artificial chromosomes, P element vectors, baculovirus vectors, or bacterial plasmids capable of being transiently introduced into the host.

The secretion vector may also contain a polyA signal such that the polyA signal is located downstream of the gene inserted into the secretion vector.

After the gene encoding the protein for which secretion is desired is inserted into the secretion vector, the secretion vector is introduced into the host cell, tissue, or organism using calcium phosphate precipitation, DEAE-Dextran, electroporation, liposome-mediated transfection, viral particles or as naked DNA. The protein encoded by the inserted gene is then purified or enriched from the supernatant using conventional techniques such as ammonium sulfate precipitation, immunoprecipitation, immunochromatography, size exclusion chromatography, ion exchange chromatography, and hplc. Alternatively, the secreted protein may be in a sufficiently enriched or pure state in the supernatant or growth media of the host to permit it to be used for its intended purpose without further enrichment.

The signal sequences may also be inserted into vectors designed for gene therapy. In such vectors, the signal sequence is operably linked to a promoter such that mRNA transcribed from the promoter encodes the signal peptide. A cloning site is located downstream of the signal sequence such that a gene encoding a protein whose secretion is desired may readily be inserted into the vector and filsed to the signal sequence. The vector is introduced into an appropriate host cell. The protein expressed from the promoter is secreted extracellularly, thereby producing a therapeutic effect.

EXAMPLE 55

Fusion Vectors

The 5' ESTs (or cDNAs or genomic DNAs obtainable therefrom) may be used to construct fusion vectors for the expression of chimeric polypeptides. The chimeric polypeptides comprise a first polypeptide portion and a second polypeptide portion. In the fusion vectors of the present invention, nucleic acids encoding the first polypeptide portion and the second polypeptide portion are joined in frame with one another so as to generate a nucleic acid encoding the chimeric polypeptide. The nucleic acid encoding the chimeric polypeptide is operably linked to a promoter which directs the expression of an mRNA encoding the chimeric polypeptide. The promoter may be in any of the expression vectors described herein including those described in Examples 30 and 54.

Preferably, the fusion vector is maintained in multiple copies in each host cell. In some embodiments, the multiple copies are maintained extrachromosomally. In other embodiments, the multiple copies result from amplification of a chromosomal sequence.

The first polypeptide portion may comprise any of the polypeptides encoded by the 5' ESTs (or cDNAs or genomic DNAs obtainable therefrom) or fragments thereof. For example, the fragments may comprise at least 6, 8, 10, 12, 15, 18, 20, 23, 25, 28, 30, 35, 40, 50 or more than 50 consecutive amino acids of the polypeptides encoded by the 5' ESTs (or cDNAs or genomic DNAs obtainable therefrom).

The second polypeptide portion may comprise any polypeptide of interest. In some embodiments, the second polypeptide portion may comprise a polypeptide having a detectable enzymatic activity such as green fluorescent protein or β galactosidase. Chimeric polypeptides in which the second polypeptide portion comprises a detectable polypeptide may be used to determine the intracellular localization of the first polypeptide portion. In such procedures, the fusion vector encoding the chimeric polypeptide is introduced into a host cell under conditions which facilitate the expression of the chimeric polypeptide. Where appropriate, the cells are treated with a detection reagent which is visible under the microscope following a catalytic reaction with the detectable polypeptide and the cellular location of the detection reagent is determined. For example, if the polypeptide having a detectable enzymatic activity is β galactosidase, the cells may be treated with Xgal. Alternatively, where the detectable polypeptide is directly detectable without the addition of a detection reagent, the intracellular location of the chimeric polypeptide is determined by performing microscopy under conditions in which the dectable polypeptide is visible. For example, if the detectable polypeptide is green fluorescent protein or a modified version thereof, microscopy is performed by exposing the host cells to light having an appropriate wavelength to cause the green fluorescent protein or modified version thereof to fluoresce.

Alternatively, the second polypeptide portion may comprise a polypeptide whose isolation, purification, or enrichment is desired. In such embodiments, the isolation, purification, or enrichment of the second polypeptide portion may be achieved by performing the immunoaffinity chromatography procedures described below using an immunoaffinity column having an antibody directed against the first polypeptide portion coupled thereto.

The proteins encoded by the 5' ESTs (or cDNAs or genomic DNAs obtainable therefrom) or fragments thereof may also be used to generate antibodies as described herein in order to identify the tissue type or cell species from which a sample is derived.

EXAMPLE 56

Identification of Tissue Types or Cell Species by Means of Labeled Tissue Specific Antibodies Identification of specific tissues is accomplished by the visualization of tissue specific antigens by means of antibody preparations according to Examples 30 and 40 which are conjugated, directly or indirectly to a detectable marker. Selected labeled antibody species bind to their specific antigen binding partner in tissue sections, cell suspensions, or in extracts of soluble proteins from a tissue sample to provide a pattern for qualitative or semi-qualitative interpretation.

Antisera for these procedures must have a potency exceeding that of the native preparation, and for that reason, antibodies are concentrated to a mg/ml level by isolation of the gamma globulin fraction, for example, by ion-exchange chromatography or by ammonium sulfate fractionation. Also, to provide the most specific antisera, unwanted antibodies, for example to common proteins, must be removed from the gamma globulin fraction, for example by means of insoluble immunoabsorbents, before the antibodies are labeled with the marker. Either monoclonal or heterologous antisera is suitable for either procedure.

1. Immunohistochemical Techniques

Purified, high-titer antibodies, prepared as described above, are conjugated to a detectable marker, as described, for example, by Fudenberg, H., Chap. 26 in: *Basic 503 Clinical Immunology*, 3$^{rd}$ Ed. Lange, Los Altos, Calif. (1980) or Rose, et al., Chap. 12 in: *Methods in ImmunodiagNOsis*, 2d Ed. John Wiley and Sons, New York (1980), the disclosures of which are incorporated herein by reference.

A fluorescent marker, either fluorescein or rhodamine, is preferred, but antibodies can also be labeled with an enzyme that supports a color producing reaction with a substrate, such as horseradish peroxidase. Markers can be added to tissue-bound antibody in a second step, as described below. Alternatively, the specific antitissue antibodies can be labeled with ferritin or other electron dense particles, and localization of the ferritin coupled antigen-antibody complexes achieved by means of an electron microscope. In yet another approach, the antibodies are radiolabeled, with, for example $^{125}$I, and detected by overlaying the antibody treated preparation with photographic emulsion.

Preparations to carry out the procedures can comprise monoclonal or polyclonal antibodies to a single protein or peptide identified as specific to a tissue type, for example, brain tissue, or antibody preparations to several antigenically distinct tissue specific antigens can be used in panels, independently or in mixtures, as required.

Tissue sections and cell suspensions are prepared for immunohistochemical examination according to common histological techniques. Multiple cryostat sections (about 4 µm, unfixed) of the unknown tissue and known control, are mounted and each slide covered with different dilutions of the antibody preparation. Sections of known and unknown tissues should also be treated with preparations to provide a positive control, a negative control, for example, pre-immune sera, and a control for non-specific staining, for example, buffer.

Treated sections are incubated in a humid chamber for 30 min at room temperature, rinsed, then washed in buffer for 30-45 min. Excess fluid is blotted away, and the marker developed.

If the tissue specific antibody was not labeled in the first incubation, it can be labeled at this time in a second antibody-antibody reaction, for example, by adding fluorescein- or enzyme-conjugated antibody against the immunoglobulin class of the antiserum-producing species, for example, fluorescein labeled antibody to mouse IgG. Such labeled sera are commercially available.

The antigen found in the tissues by the above procedure can be quantified by measuring the intensity of color or fluorescence on the tissue section, and calibrating that signal using appropriate standards.

2. Identification of Tissue Specific Soluble Proteins

The visualization of tissue specific proteins and identification of unknown tissues from that procedure is carried out using the labeled antibody reagents and detection strategy as described for immunohistochemistry; however the sample is prepared according to an electrophoretic technique to distribute the proteins extracted from the tissue in an orderly array on the basis of molecular weight for detection.

A tissue sample is homogenized using a Virtis apparatus; cell suspensions are disrupted by Dounce homogenization or osmotic lysis, using detergents in either case as required to disrupt cell membranes, as is the practice in the art. Insoluble cell components such as nuclei, microsomes, and membrane fragments are removed by ultracentrifugation, and the soluble protein-containing fraction concentrated if necessary and reserved for analysis.

A sample of the soluble protein solution is resolved into individual protein species by conventional SDS polyacrylamide electrophoresis as described, for example, by Davis, L. et al., Section 19-2 in: *Basic Methods in Molecular Biology* (P. Leder, ed), Elsevier, New York (1986), the disclosure of which is incorporated herein by reference, using a range of amounts of polyacrylamide in a set of gels to resolve the entire molecular weight range of proteins to be detected in the sample. A size marker is run in parallel for purposes of estimating molecular weights of the constituent proteins. Sample size for analysis is a convenient volume of from 5 to 55 µl, and containing from about 1 to 100 µg protein. An aliquot of each of the resolved proteins is transferred by blotting to a nitrocellulose filter paper, a process that maintains the pattern of resolution. Multiple copies are prepared. The procedure, known as Western Blot Analysis, is well described in Davis, L. et al., supra Section 19-3. One set of nitrocellulose blots is stained with Coomassie Blue dye to visualize the entire set of proteins for comparison with the antibody bound proteins. The remaining nitrocellulose filters are then incubated with a solution of one or more specific antisera to tissue specific proteins prepared as described in Examples 30 and 40. In this procedure, as in procedure A above, appropriate positive and negative sample and reagent controls are run.

In either procedure described above a detectable label can be attached to the primary tissue antigen-primary antibody complex according to various strategies and permutations thereof. In a straightforward approach, the primary specific antibody can be labeled; alternatively, the unlabeled complex can be bound by a labeled secondary anti-IgG antibody. In other approaches, either the primary or secondary antibody is conjugated to a biotin molecule, which can, in a subsequent step, bind an avidin conjugated marker. According to yet another strategy, enzyme labeled or radioactive protein A, which has the property of binding to any IgG, is bound in a final step to either the primary or secondary antibody.

EXAMPLE 57

Immunohistochemical Localization of Polypeptides

The antibodies prepared as described in Examples 30 and 40 above may be utilized to determine the cellular location of a polypeptide. The polypeptide may be any of the polypeptides encoded by the 5' ESTs (or cDNAs or genomic DNAs obtainable therefrom) or fragments thereof. For example, the fragments may comprise at least 6, 8, 10, 12, 15, 18, 20, 23, 25, 28, 30, 35, 40, 50 or more than 50 consecutive amino acids of the polypeptides encoded by the 5' ESTs (or cDNAs or genomic DNAs obtainable therefrom). In some embodiments, the polypeptide may be a chimeric polypeptide such as those encoded by the fusion vectors described above.

Cells expressing the polypeptide to be localized are applied to a microscope slide and fixed using any of the procedures typically employed in immunohistochemical localization techniques, including the methods described in Current Protocols in Molecular Biology, John Wiley and Sons, Inc. 1997. Following a washing step, the cells are contacted with the antibody. In some embodiments, the antibody is conjugated to a detectable marker as described above to facilitate detection. Alternatively, in some embodiments, after the cells have been contacted with an antibody to the polypeptide to be localized, a secondary antibody which has been conjugated to a detectable marker is placed in contact with the antibody against the polypeptide to be localized.

Thereafter, microscopy is performed under conditions suitable for visualizing the cellular location of the polypeptide.

The visualization of tissue specific antigen binding at levels above those seen in control tissues to one or more tissue specific antibodies, directed against the polypeptides encoded by 5' ESTs (or cDNAs or genomic DNAs obtainable therefrom) or fragments thereof, can identify tissues of unknown origin, for example, forensic samples, or differentiated tumor tissue that has metastasized to foreign bodily sites.

The antibodies of Example 30 and 40 may also be used in the immunoaffinity chromatography techniques described below to isolate, purify or enrich the polypeptides encoded by the 5' ESTs (or cDNAs or genomic DNAs obtainable therefrom) or fragments thereof. The immunoaffinity chromatography techniques described below may also be used to isolate, purify or enrich polypeptides which have been linked to the polypeptides encoded by the 5' ESTs (or cDNAs or genomic DNAs obtainable therefrom) or fragments thereof.

EXAMPLE 58

Immunoaffinity Chromatography

Antibodies prepared as described above are coupled to a support. Preferably, the antibodies are monoclonal antibodies, but polyclonal antibodies may also be used. The support may be any of those typically employed in immunoaffinity chromatography, including Sepharose CL-4B (Pharmacia, Piscataway, N.J.), Sepharose CL-2B (Pharmacia, Piscataway, N.J.), Affi-gel 10 (Biorad, Richmond, Calif.), or glass beads.

The antibodies may be coupled to the support using any of the coupling reagents typically used in immunoaffinity chromatography, including cyanogen bromide. After coupling the antibody to the support, the support is contacted with a sample which contains a target polypeptide whose isolation, purification or enrichment is desired. The target polypeptide may be a polypeptide encoded by the 5' ESTs (or cDNAs or genomic DNAs obtainable therefrom) or fragments thereof. The target polypeptides may also be polypeptides which have been linked to the polypeptides encoded by the 5' ESTs (or cDNAs or genomic DNAs obtainable therefrom) or fragments thereof using the fusion vectors described above.

Preferably, the sample is placed in contact with the support for a sufficient amount of time and under appropriate conditions to allow at least 50% of the target polypeptide to specifically bind to the antibody coupled to the support.

Thereafter, the support is washed with an appropriate wash solution to remove polypeptides which have non-specifically adhered to the support. The wash solution may be any of those typically employed in immunoaffinity chromatography, including PBS, Tris-lithium chloride buffer (0.1M lysine base and 0.5M lithium chloride, pH 8.0), Tris-hydrochloride buffer (0.05M Tris-hydrochloride, pH 8.0), or Tris/Triton/NaCl buffer (50 mM Tris.cl, pH 8.0 or 9.0, 0.1% Triton X-100, and 0.5M NaCl).

After washing, the specifically bound target polypeptide is eluted from the support using the high pH or low pH elution solutions typically employed in immunoaffinity chromatography. In particular, the elution solutions may contain an eluant such as triethanolamine, diethylamine, calcium chloride, sodium thiocyanate, potasssium bromide, acetic acid, or glycine. In some embodiments, the elution solution may also contain a detergent such as Triton X-100 or octyl-β-D-glucoside.

The 5' ESTs (or cDNAs or genomic DNAs obtainable therefrom) may also be used to clone sequences located upstream of the 5' ESTs which are capable of regulating gene expression, including promoter sequences, enhancer sequences, and other upstream sequences which influence transcription or translation levels. Once identified and cloned, these upstream regulatory sequences may be used in expression vectors designed to direct the expression of an inserted gene in a desired spatial, temporal, developmental, or quantitative fashion. Example 59 describes a method for cloning sequences upstream of the 5' ESTs (or cDNAs or genomic DNAs obtainable therefrom).

The 5' ESTs (or cDNAs or genomic DNAs obtainable therefrom) may also be used to clone sequences located upstream of the 5' ESTs (or cDNAs or genomic DNAs obtainable therefrom) which are capable of regulating gene expression, including promoter sequences, enhancer sequences, and other upstream sequences which influence transcription or translation levels. Once identified and cloned, these upstream regulatory sequences may be used in expression vectors designed to direct the expression of an inserted gene in a desired spatial, temporal, developmental, or quantitative fashion as described below.

EXAMPLE 59

Use of 5' ESTs to Clone Upstream Sequences from Genomic DNA

Sequences derived from 5' ESTs may be used to isolate the promoters of the corresponding genes using chromosome walking techniques. In one chromosome walking technique, which utilizes the GenomeWalker™ kit available from Clontech, five complete genomic DNA samples are each digested with a different restriction enzyme which has a 6 base recognition site and leaves a blunt end. Following digestion, oligonucleotide adapters are ligated to each end of the resulting genomic DNA fragments.

For each of the five genomic DNA libraries, a first PCR reaction is performed according to the manufacturer's instructions (which are incorporated herein by reference) using an outer adaptor primer provided in the kit and an outer gene specific primer. The gene specific primer should be selected to be specific for the 5' EST of interest and should have a melting temperature, length, and location in the 5' EST which is consistent with its use in PCR reactions. Each first PCR reaction contains 5 ng of genomic DNA, 5 µl of 10× Tth reaction buffer, 0.2 mM of each dNTP, 0.2 µM each of outer adaptor primer and outer gene specific primer, 1.1 mM of Mg(OAc)$_2$, and 1 µl of the Tth polymerase 50× mix in a total volume of 50 µl. The reaction cycle for the first PCR reaction is as follows: 1 min—94° C./2 sec—94° C., 3 min—72° C. (7 cycles)/2 sec—94° C., 3 min—67° C. (32 cycles)/5 min—67° C.

The product of the first PCR reaction is diluted and used as a template for a second PCR reaction according to the manufacturer's instructions using a pair of nested primers which are located internally on the amplicon resulting from the first PCR reaction. For example, 5 µl of the reaction product of the first PCR reaction mixture may be diluted 180 times. Reactions are made in a 50 µl volume having a composition identical to that of the first PCR reaction except the nested primers are used. The first nested primer is specific for the adaptor, and is provided with the GenomeWalker™ kit. The second nested primer is specific for the particular 5' EST for which the promoter is to be cloned and should have a melting temperature, length, and location in the 5' EST which is consistent with its use in PCR reactions. The reaction parameters of the second PCR reaction are as follows: 1 min—94° C./2 sec—94° C., 3 min—72° C. (6 cycles)/2 sec—94° C., 3 min—67° C. (25 cycles)/5 min—67° C.

The product of the second PCR reaction is purified, cloned, and sequenced using standard techniques. Alternatively, tow or more human genomic DNA libraries can be constructed by using two or more restriction enzymes. The digested genomic DNA is cloned into vectors which can be converted into single stranded, circular, or linear DNA. A biotinylated oligonucleotide comprising at least 15 nucleotides from the 5' EST sequence is hybridized to the single stranded DNA. Hybrids between the biotinylated oligonucleotide and the single stranded DNA containing the EST sequence are isolated as described in Example 29 above. Thereafter, the single stranded DNA containing the EST sequence is released from the beads and converted into double stranded DNA using a primer specific for the 5' EST sequence or a primer corresponding to a sequence included in the cloning vector. The resulting double stranded DNA is transformed into bacteria. cDNAS containing the 5' sequence are identified by colony PCR or colony hybridization.

Once the upstream genomic sequences have been cloned and sequenced as described above, prospective promoters and transcription start sites within the upstream sequences may be identified by comparing the sequences upstream of the 5 ESTs with databases containing known transcription start sites, transcription factor binding sites, or promoter sequences.

In addition, promoters in the upstream sequences may be identified using promoter reporter vectors as described in Example 60.

EXAMPLE 60

Identification of Promoters in Cloned Upstream Sequences

The genomic sequences upstream of the 5' ESTs are cloned into a suitable promoter reporter vector, such as the pSEAP-Basic, pSEAP-Enhancer, pβgal-Basic, pβgal-Enhancer, or pEGFP-1 Promoter Reporter vectors available from Clontech. Briefly, each of these promoter reporter vectors include multiple cloning sites positioned upstream of a reporter gene encoding a readily assayable protein such as secreted alkaline phosphatase, β galactosidase, or green fluorescent protein. The sequences upstream of the 5' ESTs are inserted into the cloning sites upstream of the reporter gene in both orientations and introduced into an appropriate host cell. The level of reporter protein is assayed and compared to the level obtained from a vector which lacks an insert in the cloning site. The presence of an elevated expression level in the vector containing the insert with respect to the control vector indicates the presence of a promoter in the insert. If necessary, the upstream sequences can be cloned into vectors which contain an enhancer for augmenting transcription levels from weak promoter sequences. A significant level of expression above that observed with the vector lacking an insert indicates that a promoter sequence is present in the inserted upstream sequence.

Appropriate host cells for the promoter reporter vectors may be chosen based on the results of the above described determination of expression patterns of the ESTs. For example, if the expression pattern analysis indicates that the mRNA corresponding to a particular 5' EST is expressed in fibroblasts, the promoter reporter vector may be introduced into a human fibroblast cell line.

Promoter sequences within the upstream genomic DNA may be further defined by constructing nested deletions in the upstream DNA using conventional techniques such as Exonuclease III digestion. The resulting deletion fragments can be inserted into the promoter reporter vector to determine whether the deletion has reduced or obliterated promoter activity. In this way, the boundaries of the promoters may be defined. If desired, potential individual regulatory sites within the promoter may be identified using site directed mutagenesis or linker scanning to obliterate potential transcription factor binding sites within the promoter individually or in combination. The effects of these mutations on transcription levels may be determined by inserting the mutations into the cloning sites in the promoter reporter vectors.

EXAMPLE 61

Cloning and Identification of Promoters

Using the method described in Example 59 above, sequences upstream of several genes were obtained. Using the primer pairs GGG AAG ATG GAG ATA GTA TTG CCT G (SEQ ID NO:29) and CTG CCA TGT ACA TGA TAG AGA GAT TC (SEQ ID NO:30), the promoter having the internal designation P13H2 (SEQ ID NO:31) was obtained.

Using the primer pairs GTA CCA GGGG ACT GTG ACC ATT GC (SEQ ID NO:32) and CTG TGA CCA TTG CTC CCA AGA GAG (SEQ ID NO:33), the promoter having the internal designation P15B4 (SEQ ID NO:34) was obtained.

Using the primer pairs CTG GGA TGG AAG GCA CGG TA (SEQ ID NO:35) and GAG ACC ACA CAG CTA GAC AA (SEQ ID NO:36), the promoter having the internal designation P29B6 (SEQ ID NO:37) was obtained.

FIG. 6 provides a schematic description of the promoters isolated and the way they are assembled with the corresponding 5' tags. The upstream sequences were screened for the presence of motifs resembling transcription factor binding sites or known transcription start sites using the computer program MatInspector release 2.0, August 1996.

FIG. 7 describes the transcription factor binding sites present in each of these promoters. The columns labeled matrice provides the name of the MatInspector matrix used. The column labeled position provides the 5' postion of the promoter site. Numeration of the sequence starts from the transcription site as determined by matching the genomic sequence with the 5' EST sequence. The column labeled "orientation" indicates the DNA strand on which the site is found, with the +strand bding the coding strand as determined by matching the genomic sequence with the sequence of the 5' EST. The column labeled "score" provides the MatInspector score found for this site. The column labeled "length" provides the length of the site in nucleotides. The column labeled "sequence" provides the sequence of the site found.

Bacterial clones containing plasmids containing the promoter sequences described above described above are presently stored in the inventor's laboratories under the internal identification numbers provided above. The inserts may be recovered from these stored materials by growing an aliquot of the appropriate bacterial clone in the appropriate medium. The plasmid DNA can then be isolated using plasmid isolation procedures familiar to those skilled in the art such as alkaline lysis minipreps or large scale alkaline lysis plasmid isolation procedures. If desired the plasmid DNA may be further enriched by centrifugation on a cesium chloride gradient, size exclusion chromatography, or anion exchange chromatography. The plasmid DNA obtained using these procedures may then be manipulated using standard cloning techniques familiar to those skilled in the art. Alternatively, a PCR can be done with primers designed at both ends of the EST insertion. The PCR product which corresponds to the 5' EST can then be manipulated using standard cloning techniques familiar to those skilled in the art.

The promoters and other regulatory sequences located upstream of the 5' ESTs may be used to design expression vectors capable of directing the expression of an inserted gene in a desired spatial, temporal, developmental, or quantitative manner. A promoter capable of directing the desired spatial, temporal, developmental, and quantitative patterns may be selected using the results of the expression analysis described in Example 26 above. For example, if a promoter which confers a high level of expression in muscle is desired, the promoter sequence upstream of a 5' EST derived from an mRNA which is expressed at a high level in muscle, as determined by the method of Example 26, may be used in the expression vector.

Preferably, the desired promoter is placed near multiple restriction sites to facilitate the cloning of the desired insert downstream of the promoter, such that the promoter is able to drive expression of the inserted gene. The promoter may be inserted in conventional nucleic acid backbones designed for extrachromosomal replication, integration into the host chromosomes or transient expression. Suitable backbones for the present expression vectors include retroviral backbones, backbones from eukaryotic episomes such as SV40 or Bovine Papilloma Virus, backbones from bacterial episomes, or artificial chromosomes.

Preferably, the expression vectors also include a polyA signal downstream of the multiple restriction sites for directing the polyadenylation of mRNA transcribed from the gene inserted into the expression vector.

Following the identification of promoter sequences using the procedures of Examples 59-61, proteins which interact with the promoter may be identified as described in Example 62 below.

EXAMPLE 62

Identification of Proteins which Interact with Promoter Sequences, Upstream Regulatory Sequences, or mRNA Sequences within the promoter region which are likely to bind transcription factors may be identified by homology to known transcription factor binding sites or through conventional mutagenesis or deletion analyses of reporter plasmids containing the promoter sequence. For example, deletions may be made in a reporter plasmid containing the promoter sequence of interest operably linked to an assayable reporter gene. The reporter plasmids carrying various deletions within the promoter region are transfected into an appropriate host cell and the effects of the deletions on expression levels is assessed. Transcription factor binding sites within the regions in which deletions reduce expression levels may be further localized using site directed mutagenesis, linker scanning analysis, or other techniques familiar to those skilled in the art.

Nucleic acids encoding proteins which interact with sequences in the promoter may be identified using one-hybrid systems such as those described in the manual accompanying the Matchmaker One-Hybrid System kit avalilabe from Clontech (Catalog No. K1603-1), the disclosure of which is incorporated herein by reference. Briefly, the Matchmaker One-hybrid system is used as follows. The target sequence for which it is desired to identify binding proteins is cloned upstream of a selectable reporter gene and integrated into the yeast genome. Preferably, multiple copies of the target sequences are inserted into the reporter plasmid in tandem.

A library comprised of fusions between cDNAs to be evaluated for the ability to bind to the promoter and the activation domain of a yeast transcription factor, such as GAL4, is transformed into the yeast strain containing the integrated reporter sequence. The yeast are plated on selective media to select cells expressing the selectable marker linked to the promoter sequence. The colonies which grow on the selective media contain genes encoding proteins which bind the target sequence. The inserts in the genes encoding the fusion proteins are further characterized by sequencing. In addition, the inserts may be inserted into expression vectors or in vitro transcription vectors. Binding of the polypeptides encoded by the inserts to the promoter DNA may be confirmed by techniques familiar to those skilled in the art, such as gel shift analysis or DNAse protection analysis.

VII. Use of 5' ESTs (or cDNAs or Genomic DNAs Obtainable therefrom) in Gene Therapy The present invention also comprises the use of 5' ESTs (or cDNAs or genomic DNAs obtainable therefrom) in gene therapy strategies, including antisense and triple helix strategies as described in Examples 63 and 64 below. In antisense approaches, nucleic acid sequences complementary to an mRNA are hybridized to the mRNA intracellularly, thereby blocking the expression of the protein encoded by the mRNA. The antisense sequences may prevent gene expression through a variety of mechanisms. For example, the antisense sequences may inhibit the ability of ribosomes to translate the mRNA. Alternatively, the antisense sequences may block transport of the mRNA from the nucleus to the cytoplasm, thereby limiting the amount of mRNA available for translation. Another mechanism through which antisense sequences may inhibit gene expression is by interfering with mRNA splicing. In yet another strategy, the antisense nucleic acid may be incorporated in a ribozyme capable of specifically cleaving the target mRNA.

EXAMPLE 63

Preparation and Use of Antisense Oligonucleotides

The antisense nucleic acid molecules to be used in gene therapy may be either DNA or RNA sequences. They may comprise a sequence complementary to the sequence of the 5' EST or cDNAs or genomic DNAs obtainable therefrom. The antisense nucleic acids should have a length and melting temperature sufficient to permit formation of an intracellular duplex having sufficient stability to inhibit the expression of the mRNA in the duplex. Strategies for designing antisense nucleic acids suitable for use in gene therapy are disclosed in Green et al., Ann. Rev. Biochem. 55:569-597 (1986) and Izant and Weintraub, Cell 36:1007-1015 (1984), which are hereby incorporated by reference.

In some strategies, antisense molecules are obtained from a nucleotide sequence encoding a protein by reversing the orientation of the coding region with respect to a promoter so as to transcribe the opposite strand from that which is normally transcribed in the cell. The antisense molecules may be transcribed using in vitro transcription systems such as those which employ T7 or SP6 polymerase to generate the transcript. Another approach involves transcription of the antisense nucleic acids in vivo by operably linking DNA containing the antisense sequence to a promoter in an expression vector.

Alternatively, oligonucleotides which are complementary to the strand normally transcribed in the cell may be synthesized in vitro. Thus, the antisense nucleic acids are complementary to the corresponding mRNA and are capable of hybridizing to the mRNA to create a duplex. In some embodiments, the antisense sequences may contain modified sugar phosphate backbones to increase stability and make them less sensitive to RNase activity. Examples of modifications suitable for use in antisense strategies are described by Rossi et al., Pharmacol. Ther. 50(2):245-254, (1991).

Various types of antisense oligonucleotides complementary to the sequence of the 5' EST or cDNAs or genomic DNAs obtainable therefrom may be used. In one preferred embodiment, stable and semi-stable antisense oligonucleotides described in International Application No. PCT WO94/23026, hereby incorporated by reference, are used. In these moleucles, the 3' end or both the 3' and 5' ends are engaged in intramolecular hydrogen bonding between complementary base pairs. These molecules are better able to withstand exonuclease attacks and exhibit increased stability compared to conventional antisense oligonucleotides.

In another preferred embodiment, the antisense oligodeoxynucleotides against herpes simplex virus types 1 and 2 described in International Application No. WO 95/04141, hereby incorporated by reference, are used.

In yet another preferred embodiment, the covalently cross-linked antisense oligonucleotides described in International Application No. WO 96/31523, hereby incorporated by reference, are used. These double- or single-stranded oligonucleotides comprise one or more, respectively, inter- or intra-oligonucleotide covalent cross-linkages, wherein the linkage consists of an amide bond between a primary amine group of one strand and a carboxyl group of the other strand or of the same strand, respectively, the primary amine group being directly substituted in the 2' position of the strand nucleotide monosaccharide ring, and the carboxyl group being carried by an aliphatic spacer group substituted on a nucleotide or nucleotide analog of the other strand or the same strand, respectively.

The antisense oligodeoxynucleotides and oligonucleotides disclosed in International Application No. WO 92/18522, incorporated by reference, may also be used. These molecules are stable to degradation and contain at least one transcription control recognition sequence which binds to control proteins and are effective as decoys therefor. These molecules may contain "hairpin" structures, "dumbbell" structures, "modified dumbbell" structures, "cross-linked" decoy structures and "loop" structures.

In another preferred embodiment, the cyclic double-stranded oligonucleotides described in European Patent Application No. 0 572 287 A2, hereby incorporated by reference are used. These ligated oligonucleotide "dumbbells" contain the binding site for a transcription factor and inhibit expression of the gene under control of the transcription factor by sequestering the factor.

Use of the closed antisense oligonucleotides disclosed in International Application No. WO 92/19732, hereby incorporated by reference, is also contemplated. Because these molecules have no free ends, they are more resistant to degradation by exonucleases than are conventional oligonucleotides. These oligonucleotides may be multifunctional, interacting with several regions which are not adjacent to the target mRNA.

The appropriate level of antisense nucleic acids required to inhibit gene expression may be determined using in vitro expression analysis. The antisense molecule may be introduced into the cells by diffusion, injection, infection or transfection using procedures known in the art. For example, the antisense nucleic acids can be introduced into the body as a bare or naked oligonucleotide, oligonucleotide encapsulated in lipid, oligonucleotide sequence encapsidated by viral protein, or as an oligonucleotide operably linked to a promoter contained in an expression vector. The expression vector may be any of a variety of expression vectors known in the art, including retroviral or viral vectors, vectors capable of extrachromosomal replication, or integrating vectors. The vectors may be DNA or RNA.

The antisense molecules are introduced onto cell samples at a number of different concentrations preferably between $1 \times 10^{-10}$M to $1 \times 10^{-4}$M. Once the minimum concentration that can adequately control gene expression is identified, the optimized dose is translated into a dosage suitable for use in vivo. For example, an inhibiting concentration in culture of $1 \times 10^{-7}$ translates into a dose of approximately 0.6 mg/kg bodyweight. Levels of oligonucleotide approaching 100 mg/kg bodyweight or higher may be possible after testing the toxicity of the oligonucleotide in laboratory animals. It is additionally contemplated that cells from the vertebrate are removed, treated with the antisense oligonucleotide, and reintroduced into the vertebrate.

It is further contemplated that the antisense oligonucleotide sequence is incorporated into a ribozyme sequence to enable the antisense to specifically bind and cleave its target mRNA. For technical applications of ribozyme and antisense oligonucleotides see Rossi et al., supra.

In a preferred application of this invention, the polypeptide encoded by the gene is first identified, so that the effectiveness of antisense inhibition on translation can be monitored using techniques that include but are not limited to antibody-mediated tests such as RIAs and ELISA, functional assays, or radiolabeling.

The 5' ESTs of the present invention (or cDNAs or genomic DNAs obtainable therefrom) may also be used in gene therapy approaches based on intracellular triple helix formation. Triple helix oligonucleotides are used to inhibit transcription from a genome. They are particularly useful for studying alterations in cell activity as it is associated with a particular gene. The 5' EST sequences (or cDNAs or genomic DNAs obtainable therefrom) of the present invention or, more preferably, a portion of those sequences, can be used to inhibit gene expression in individuals having diseases associated with expression of a particular gene. Similarly, a portion of the 5' EST (or cDNAs or genomic DNAs obtainable therefrom) can be used to study the effect of inhibiting transcription of a particular gene within a cell. Traditionally, homopurine sequences were considered the most useful for triple helix strategies. However, homopyrimidine sequences can also inhibit gene expression. Such homopyrimidine oligonucleotides bind to the major groove at homopurine:homopyrimidine sequences. Thus, both types of sequences from either the 5' EST or from the gene corresponding to the 5' EST are contemplated within the scope of this invention.

EXAMPLE 64

Preparation and Use of Triple Helix Probes

The sequences of the 5' ESTs (or cDNAs or genomic DNAs obtainable therefrom) are scanned to identify 10-mer to 20-mer homopyrimidine or homopurine stretches which could be used in triple-helix based strategies for inhibiting gene expression. Following identification of candidate homopyrimidine or homopurine stretches, their efficiency in inhibiting gene expression is assessed by introducing varying amounts of oligonucleotides containing the candidate sequences into tissue culture cells which normally express the target gene. The oligonucleotides may be prepared on an oligonucleotide synthesizer or they may be purchased commercially from a company specializing in custom oligonucleotide synthesis, such as GENSET, Paris, France.

The oligonucleotides may be introduced into the cells using a variety of methods known to those skilled in the art, including but not limited to calcium phosphate precipitation, DEAE-Dextran, electroporation, liposome-mediated transfection or native uptake.

Treated cells are monitored for altered cell function or reduced gene expression using techniques such as Northern blotting, RNase protection assays, or PCR based strategies to monitor the transcription levels of the target gene in cells which have been treated with the oligonucleotide. The cell functions to be monitored are predicted based upon the homologies of the target gene corresponding to the 5' EST from which the oligonucleotide was derived with known gene sequences that have been associated with a particular function. The cell functions can also be predicted based on the presence of abnormal physiologies within cells derived from individuals with a particular inherited disease, particularly when the 5' EST is associated with the disease using techniques described in Example 53.

The oligonucleotides which are effective in inhibiting gene expression in tissue culture cells may then be introduced in vivo using the techniques described above and in Example 69 at a dosage calculated based on the in vitro results, as described in Example 69.

In some embodiments, the natural (beta) anomers of the oligonucleotide units can be replaced with alpha anomers to render the oligonucleotide more resistant to nucleases. Further, an intercalating agent such as ethidium bromide, or the like, can be attached to the 3' end of the alpha oligonucleotide to stabilize the triple helix. For information on the generation of oligonucleotides suitable for triple helix formation see Griffin et al. (Science 245:967-971 (1989), which is hereby incorporated by this reference).

EXAMPLE 65

Use of cDNAs Obtained Using the 5' ESTs to Express an Encoded Protein in a Host Organism The cDNAs obtained as described above using the 5' ESTs of the present invention may also be used to express an encoded protein in a host organism to produce a beneficial effect. In such procedures, the encoded protein may be transiently expressed in the host organism or stably expressed in the host organism. The encoded protein may have any of the activities described above. The encoded protein may be a protein which the host organism lacks or, alternatively, the encoded protein may augment the existing levels of the protein in the host organism.

A full length cDNA encoding the signal peptide and the mature protein, or an extended cDNA encoding only the mature protein is introduced into the host organism. The cDNA may be introduced into the host organism using a variety of techniques known to those of skill in the art. For example, the cDNA may be injected into the host organism as naked DNA such that the encoded protein is expressed in the host organism, thereby producing a beneficial effect.

Alternatively, the cDNA may be cloned into an expression vector downstream of a promoter which is active in the host organism. The expression vector may be any of the expression vectors designed for use in gene therapy, including viral or retroviral vectors.

The expression vector may be directly introduced into the host organism such that the encoded protein is expressed in the host organism to produce a beneficial effect. In another approach, the expression vector may be introduced into cells in vitro. Cells containing the expression vector are thereafter selected and introduced into the host organism, where they express the encoded protein to produce a beneficial effect.

As discussed above, the cDNAs or portions thereof obtained using the 5' ESTs of the present invention can be used for various purposes. The cDNAs can be used to express recombinant protein for analysis, characterization or therapeutic use; as markers for tissues in which the corresponding protein is preferentially expressed (either constitutively or at a particular stage of tissue differentiation or development or in disease states); as molecular weight markers on Southern gels; as chromosome markers or tags (when labeled) to identify chromosomes or to map related gene positions; to compare with endogenous DNA sequences in patients to identify potential genetic disorders; as probes to hybridize and thus discover novel, related DNA sequences; as a source of information to derive PCR primers for genetic fingerprinting; for selecting and making oligomers for attachment to a "gene chip" or other support, including for examination for expression patterns; to raise anti-protein antibodies using DNA immunization techniques; and as an antigen to raise anti-DNA antibodies or elicit another immune response. Where the polynucleotide encodes a protein which binds or potentially binds to another protein (such as, for example, in a receptor-ligand interaction), the polynucleotide can also be used in interaction trap assays (such as, for example, that described in Gyuris et al., Cell 75:791-803 (1993)) to identify polynucleotides encoding the other protein with which binding occurs or to identify inhibitors of the binding interaction.

The proteins or polypeptides encoded by the cDNAs can similarly be used in assays to determine biological activity, including in a panel of multiple proteins for high-throughput screening; to raise antibodies or to elicit another immune response; as a reagent (including the labeled reagent) in assays designed to quantitatively determine levels of the protein (or its receptor) in biological fluids; as markers for tissues in which the corresponding protein is preferentially expressed (either constitutively or at a particular stage of tissue differentiation or development or in a disease state); and, of course, to isolate correlative receptors or ligands. Where the protein binds or potentially binds to another protein (such as, for example, in a receptor-ligand interaction), the protein can be used to identify the other protein with which binding occurs or to identify inhibitors of the binding interaction. Proteins involved in these binding interactions can also be used to screen for peptide or small molecule inhibitors or agonists of the binding interaction.

Any or all of these research utilities are capable of being developed into reagent grade or kit format for commercialization as research products.

Methods for performing the uses listed above are well known to those skilled in the art. References disclosing such methods include without limitation "Molecular Cloning; A Laboratory Manual", 2d ed., Cole Spring Harbor Laboratory Press, Sambrook, J., E. F. Fritsch and T. Maniatis eds., 1989, and "Methods in Enzymology; Guide to Molecular Cloning Techniques", Academic Press, Berger, S. L. and A. R. Kimmel eds., 1987.

Polynucleotides and proteins obtained using the 5' ESTs of the present invention can also be used as nutritional sources or supplements. Such uses include without limitation use as a protein or amino acid supplement, use as a carbon source, use as a nitrogen source and use as a source of carbohydrate. In such cases the protein or polynucleotide of the invention can be added to the feed of a particular organism or can be administered as a separate solid or liquid preparation, such as in the form of powder, pills, solutions, suspensions or capsules. In the case of microorganisms, the protein or polynucleotide of the invention can be added to the medium in or on which the microorganism is cultured.

EXAMPLE 66

Use of Signal Peptides to Import Proteins into Cells

The short core hydrophobic region (h) of signal peptides encoded by the sequences of SEQ ID NOs. 38-1756 may also be used as a carrier to import a peptide or a protein of interest, so-called cargo, into tissue culture cells (Lin et al., J. Biol. Chem., 270: 14225-14258 (1995); Du et al., J. Peptide Res., 51: 235-243 (1998); Rojas et al., Nature Biotech., 16: 370-375 (1998)).

When cell permeable peptides of limited size (approximately up to 25 amino acids) are to be translocated across cell membrane, chemical synthesis may be used in order to add the h region to either the C-terminus or the N-terminus to the cargo peptide of interest. Alternatively, when longer peptides or proteins are to be imported into cells, nucleic acids can be genetically engineered, using techniques familiar to those skilled in the art, in order to link the extended cDNA sequence encoding the h region to the 5' or the 3' end of a DNA sequence coding for a cargo polypeptide. Such genetically engineered nucleic acids are then translated either in vitro or in vivo after transfection into appropriate cells, using conventional techniques to produce the resulting cell permeable polypeptide. Suitable hosts cells are then simply incubated with the cell permeable polypeptide which is then translocated across the membrane.

This method may be applied to study diverse intracellular functions and cellular processes. For instance, it has been used to probe functionally relevant domains of intracellular proteins and to examine protein-protein interactions involved in signal transduction pathways (Lin et al., supra; Lin et al., J. Biol. Chem., 271:5305-5308 (1996); Rojas et al., J. Biol. Chem., 271: 27456-27461 (1996); Liu et al., Proc. Natl. Acad. Sci. USA, 93: 11819-11824 (1996); Rojas et al., Bioch. Biophys. Res. Commun., 234: 675-680 (1997)).

Such techniques may be used in cellular therapy to import proteins producing therapeutic effects. For instance, cells isolated from a patient may be treated with imported therapeutic proteins and then re-introduced into the host organism.

Alternatively, the h region of signal peptides of the present invention could be used in combination with a nuclear localization signal to deliver nucleic acids into cell nucleus. Such oligonucleotides may be antisense oligonucleotides or oligonucleotides designed to form triple helixes, as described-above, in order to inhibit processing and maturation of a target cellular RNA.

EXAMPLE 67

Computer Embodiments

As used herein the term "cDNA codes of SEQ ID NOs. 38-1756" encompasses the nucleotide sequences of SEQ ID NOs. 38-1756, fragments of SEQ ID NOs. 38-1756, nucleotide sequences homologous to SEQ ID NOs. 38-1756 or homologous to fragments of SEQ ID NOs. 38-1756, positional segments of the nucleotide sequences of SEQ ID NOs: 38-1756, fragments of positional segments of the nucleotide sequences of SEQ ID NOs: 38-1756, and sequences complementary to all of the preceding sequences. The fragments include fragments of SEQ ID NOs. 38-1756 comprising at least 8, 10, 12, 15, 18, 20, 25, 28, 30, 35, 40, 50, 75, 100, 150, 200, 300, 400, 500, or more than 500 consecutive nucleotides of SEQ ID NOs. 38-1756 to the extent that fragments of such lengths are consistent with the lengths of specific sequences. Positional segments of the nucleotide sequences of SEQ ID NOs: 38-1756 and fragments of positional segments of the nucleotide sequences of SEQ ID NOs: 38-1756 are as defmed above. Homologous sequences and fragments of SEQ ID NOs. 38-1756 refer to a sequence having at least 99%, 98%, 97%, 96%, 95%, 90%, 85%, 80%, or 75% homology to these sequences using any of the algorithms and parameters described herein, including BLAST2N with the default parameters or with any modified parameters. Homologous sequences also include RNA sequences in which uridines replace the thymines in the cDNA codes of SEQ ID NOs. 38-1756. The homologous sequences may be obtained using any of the procedures described herein or may result from the correction of a sequencing error as described above. It will be appreciated that the cDNA codes of SEQ ID NOs. 38-1756 can be represented in the traditional single character format (See the inside back cover of Styer, Lubert. *Biochemistry*, $3^{rd}$ edition. W. H Freeman & Co., New York.) or in any other format which records the identity of the nucleotides in a sequence.

As used herein the term "polypeptide codes of SEQ ID NOS. 1757-3475" encompasses the polypeptide sequence of SEQ ID NOs. 1757-3475 which are encoded by the cDNAs of SEQ ID NOs. 1757-3475, polypeptide sequences homologous to the polypeptides of SEQ ID NOS. 1757-3475, fragments of any of the preceding sequences, positional segments of the polypeptides of SEQ ID NOs: 1757-3475, polypeptides homologous to positional segments of the polypeptides of SEQ ID NOs: 1757-3475, fragments of positional segments of the polypeptides the polypeptides of SEQ ID NOs: 1757-3475, and polypeptides homologous to fragments of positional segments of the polypeptides of SEQ ID NOs: 1757-3475. Homologous polypeptide sequences refer to a polypeptide sequence having at least 99%, 98%, 97%, 96%, 95%, 90%, 85%, 80%, 75% homology to one of the polypeptide sequences of SEQ ID NOS. 1757-3475, positional segments of the polypeptides of SEQ ID NOs: 1757-3475, or fragments of positional segments of the polypeptides of SEQ ID NOs: 1757-3475. Homology may be determined using any of the computer programs and parameters described herein, including FASTA with the default parameters or with any modified parameters. The homologous sequences may be obtained using any of the procedures described herein or may result from the correction of a sequencing error as described above. The polypeptide fragments comprise at least 5, 8, 10, 12, 15, 20, 25, 30, 35, 40, 50, 60, 75, 100, 150 or 200 consecutive amino acids of the polypeptides of SEQ ID NOS. 1757-3475. Positional segments of the polypeptides of SEQ ID NOs: 1757-3475 and fragments of positional segments of the polypeptides of SEQ ID NOs: 1757-3475 have the meanings provided above. It will be appreciated that the polypeptide codes of the SEQ ID NOS. 1757-3475 can be represented in the traditional single character format or three letter format (See the inside back cover of Starrier, Lubert. *Biochemistry*, $3^{rd}$ edition. W. H Freeman & Co., New York.) or in any other format which relates the identity of the polypeptides in a sequence.

Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA, and CLUSTALW (Pearson and Lipman, 1988, *Proc. Natl. Acad Sci. USA* 85(8): 2444-2448; Altschul et al., 1990, *J. Mol. Biol.* 215(3):403-410; Thompson et al., 1994, *Nucleic Acids Res.* 22(2):4673-4680; Higgins et al., 1996, *Methods Enzymol.* 266:383-402; Altschul et al., 1990, *J. Mol. Biol.* 215(3):403-410; Altschul et al., 1993, *Nature Genetics* 3:266-272).

In some embodiments, protein and nucleic acid sequence homologies are evaluated using the Basic Local Alignment Search Tool ("BLAST") which is well known in the art (see, e.g., Karlin and Altschul, 1990, *Proc. Natl. Acad. Sci. USA* 87:2267-2268; Altschul et al., 1990, *J. Mol. Biol.* 215:403-410; Altschul et al., 1993, *Nature Genetics* 3:266-272; Altschul et al., 1997, *Nuc. Acids Res.* 25:3389-3402). In particular, five specific BLAST programs are used to perform the following tasks:
(1) BLASTP and BLAST3 compares an amino acid query sequence against a protein sequence database;
(2) BLASTN compares a nucleotide query sequence against a nucleotide sequence database;
(3) BLASTX compares the six-frame conceptual translation products of a query nucleotide sequence (both strands) against a protein sequence database;
(4) TBLASTN compares a query protein sequence against a nucleotide sequence database translated in all six reading frames (both strands); and
(5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is preferably obtained from a protein or nucleic acid sequence database. High-scoring segment pairs are preferably identified (i.e., aligned) by means of a scoring matrix, many of which are known in the art. Preferably, the scoring matrix used is the BLOSUM62 matrix (Gonnet et al., 1992, *Science* 256:1443-1445; Henikoff and Henikoff, 1993, *Proteins* 17:49-61). Less preferably, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation)

The BLAST programs evaluate the statistical significance of all high-scoring segment pairs identified, and preferably selects those segments which satisfy a user-specified threshold of significance, such as a user-specified percent homology. Preferably, the statistical significance of a high-scoring segment pair is evaluated using the statistical significance formula of Karlin (see, e.g., Karlin and Altschul, 1990, *Proc. Natl. Acad. Sci. USA* 87:2267-2268).

The parameters used with the above algorithms may be adapted depending on the sequence length and degree of homology studied. In some embodiments, the parameters may be the default parameters used by the algorithms in the absence of instructions from the user.

In some embodiments, the level of homology may be determiined using the FASTDB algorithm described in Brutlag et al. *Comp. App. Biosci.* 6:237-245, 1990. In such analyses the parameters may be selected as follows: Matrix=Unitary, k-tuple=4, Mismatch Penalty=1, Joining Penalty=30, Randomization Group Length=0, Cutoff Score=1, Gap Penalty=5, Gap Size Penalty=0.05, Window Size=500 or the length of the sequence which hybridizes to the probe, whichever is shorter. Because the FASTDB program does not consider 5' or 3' truncations when calculating homology levels, if the sequence homologous to the 5' EST (or cDNA or genomic DNA obtainable therefrom) is truncated relative to the sequence of the 5' EST (or cDNA or genomic DNA obtainable therefrom) the homology level is manually adjusted by calculating the number of nucleotides of the 5' EST (or cDNA or genomic DNA obtainable therefrom) which are not matched or aligned with the sequence, determining the percentage of total nucleotides of the homologous sequence which the non-matched or non-aligned nucleotides represent, and subtracting this percentage from the homology level. For example, if the homologous sequence is 700 nucleotides in length and the 5' EST (or cDNA or genomic DNA obtainable therefrom) sequence is 1000 nucleotides in length wherein the first 300 bases at the 5' end of the 5' EST (or cDNA or genomic DNA obtainable therefrom) are absent from the hybridizing sequence, and wherein the overlapping 700 nucleotides are identical, the homology level would be adjusted as follows. The non-matched, non-aligned 300 bases represent 30% of the length of the 5' EST (or cDNA or genomic DNA obtainable therefrom). If the overlapping 700 nucleotides are 100% identical, the adjusted homology level would be 100−30=70% homology. It should be noted that the preceding adjustments are only made when the non-matched or non-aligned nucleotides are at the 5' or 3' ends. No adjustments are made if the non-matched or non-aligned sequences are internal or under any other conditions.

Using the above algorithms with parameters depending on the sequence length and degree of homology studied, for example the default parameters used by the algorithms in the absence of instructions from the user, one can identify nucleic acids encoding proteins having at least 99%, at least 98%, at least 97%, at least 96%, at least 95%, at least 90%, at least 85%, at least 80% or at least 75% homology to the protein encoded by the 5' EST (or cDNA or genomic DNA obtainable therefrom). In some embodiments, the homology levels can be determined using the "default" opening penalty and the "default" gap penalty, and a scoring matrix such as PAM 250 (a standard scoring matrix; see Dayhoff et al., in: Atlas of Protein Sequence and Structure, Vol. 5, Supp. 3 (1978)).

Alternatively, the level of polypeptide homology may be determined using the FASTDB algorithm described by Brutlag et al. Comp. App. Biosci. 6:237-245, 1990. In such analyses the parameters may be selected as follows: Matrix=PAM 0, k-tuple=2, Mismatch Penalty=1, Joining Penalty=20, Randomization Group Length=0, Cutoff Score=1, Window Size=Sequence Length, Gap Penalty=5, Gap Size Penalty=0.05, Window Size=500 or the length of the homologous sequence, whichever is shorter. If the homologous amino acid sequence is shorter than the amino acid sequence encoded by the 5' EST (or cDNA or genomic DNA obtainable therefrom) as a result of an N terminal and/or C terminal deletion the results may be manually corrected as follows. First, the number of amino acid residues of the amino acid sequence encoded by the 5' EST (or cDNA or genomic DNA obtainable therefrom) which are not matched or aligned with the homologous sequence is determined. Then, the percentage of the length of the sequence encoded by the 5' EST (or cDNA or genomic DNA obtainable therefrom) which the non-matched or non-aligned amino acids represent is calculated. This percentage is subtracted from the homology level. For example wherein the amino acid sequence encoded by the 5' EST (or cDNA or genomic DNA obtainable therefrom) is 100 amino acids in length and the length of the homologous sequence is 80 amino acids and wherein the amino acid sequence encoded by the 5' EST (or cDNA or genomic DNA obtainable therefrom) is truncated at the N terminal end with respect to the homologous sequence, the homology level is calculated as follows. In the preceding scenario there are 20 non-matched, non-aligned amino acids in the sequence encoded by the 5' EST (or cDNA or genomic DNA obtainable therefrom). This represents 20% of the length of the amino acid sequence encoded by the 5' EST (or cDNA or genomic DNA obtainable therefrom). If the remaining amino acids are 1005 identical between the two sequences, the homology level would be 100%−20%=80% homology. No adjustments are made if the non-matched or non-aligned sequences are internal or under any other conditions.

It will be appreciated by those skilled in the art that the cDNA codes of SEQ ID NOs. 38-1756 and polypeptide codes of SEQ ID NOS. 1757-3475 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the cDNA codes of SEQ ID NOs. 38-1756, one or more of the polypeptide codes of SEQ ID NOS. 1757-3475. Another aspect of the present invention is a computer readable medium having recorded thereon at least 2, 5, 10, 15, 20, 25, 30, or 50 cDNA codes of SEQ ID NOs. 38-1756. Another aspect of the present invention is a computer readable medium having recorded thereon at least 2, 5, 10, 15, 20, 25, 30, or 50 polypeptide codes of SEQ ID NOS. 1757-3475.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Figure 8:
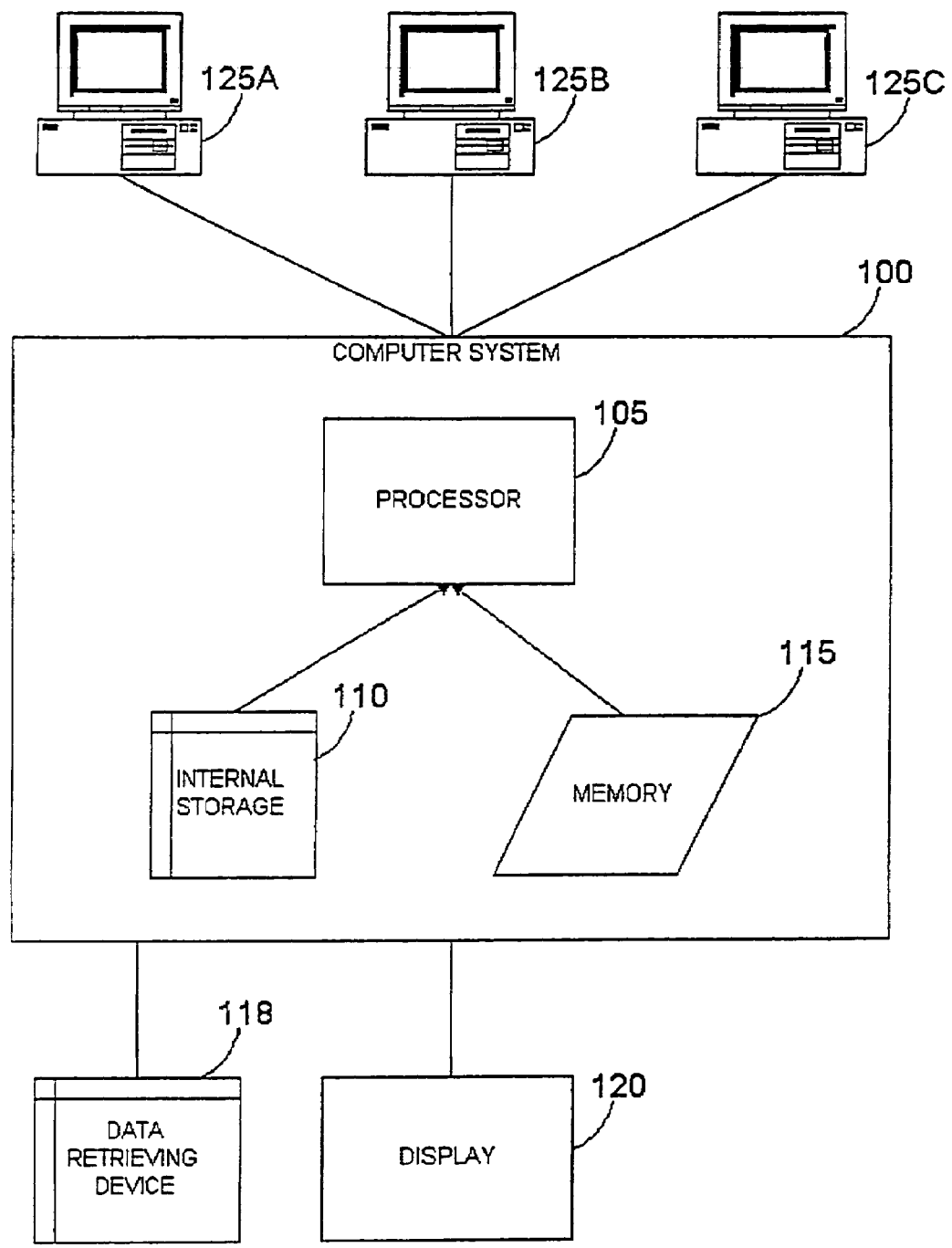
FIG. 8 is a block diagram of an exemplary computer system.

Embodiments of the present invention include systems, particularly computer systems which store and manipulate the sequence information described herein. One example of a computer system 100 is illustrated in block diagram form in FIG. 8. As used herein, "a computer system" refers to the hardware components, software components, and data storage components used to analyze the nucleotide sequences of the cDNA codes of SEQ ID NOs. 38-1756, or the amino acid sequences of the polypeptide codes of SEQ ID NOS. 1757-3475. In one embodiment, the computer system 100 is a Sun Enterprise 1000 server (Sun Microsystems, Palo Alto, Calif.). The computer system 100 preferably includes a processor for processing, accessing and manipulating the sequence data. The processor 105 can be any well-known type of central processing unit, such as the Pentium III from Intel Corporation, or similar processor from Sun, Motorola, Compaq or International Business Machines.

Preferably, the computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one particular embodiment, the computer system 100 includes a processor 105 connected to a bus which is connected to a main memory 115 (preferably implemented as RAM) and one or more internal data storage devices 110, such as a hard drive and/or other computer readable media having data recorded thereon. In some embodiments, the computer system 100 further includes one or more data retrieving device 118 for reading the data stored on the internal data storage devices 110.

The data retrieving device 118 may represent, for example, a floppy disk drive, a compact disk drive, a magnetic tape drive, etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125 A-C in a network or wide area network to provide centralized access to the computer system 100.

Software for accessing and processing the nucleotide sequences of the cDNA codes of SEQ ID NOs. 38-1756, or the amino acid sequences of the polypeptide codes of SEQ ID NOS. 1757-3475 (such as search tools, compare tools, and modeling tools etc.) may reside in main memory 115 during execution.

In some embodiments, the computer system 100 may further comprise a sequence comparer for comparing the above-described cDNA codes of SEQ ID NOs. 38-1756 or polypeptide codes of SEQ ID NOS. 1757-3475 stored on a computer readable medium to reference nucleotide or polypeptide sequences stored on a computer readable medium. A "sequence comparer" refers to one or more programs which are implemented on the computer system 100 to compare a nucleotide or polypeptide sequence with other nucleotide or polypeptide sequences and/or compounds including but not limited to peptides, peptidomimetics, and chemicals stored within the data storage means. For example, the sequence comparer may compare the nucleotide sequences of the cDNA codes of SEQ ID NOs. 38-1756, or the amino acid sequences of the polypeptide codes of SEQ ID NOS. 1757-3475 stored on a computer readable medium to reference sequences stored on a computer readable medium to identify homologies, motifs implicated in biological function, or structural motifs. The various sequence comparer programs identified elsewhere in this patent specification are particularly contemplated for use in this aspect of the invention.

Figure 9:
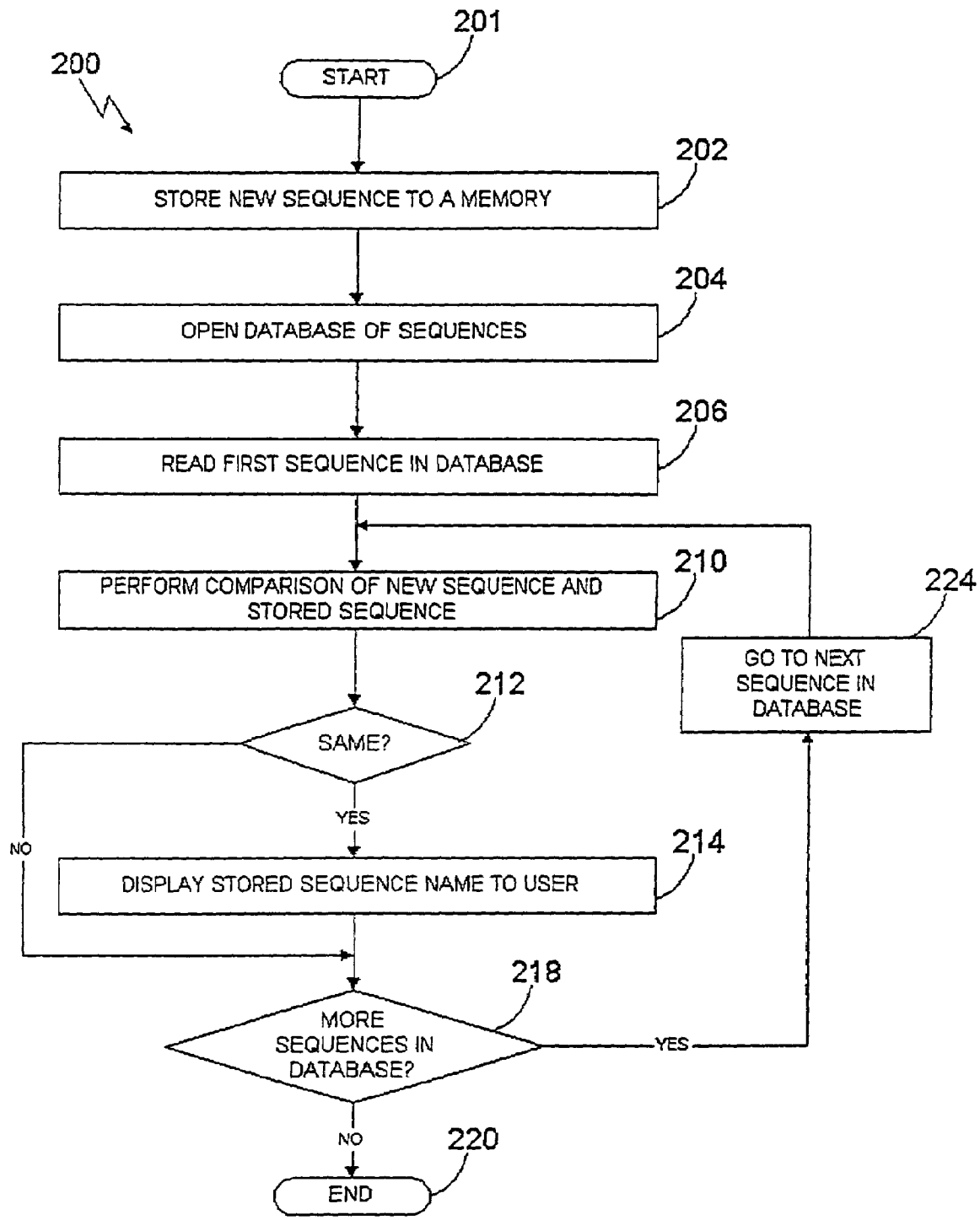
FIG. 9 is a flow diagram illustrating one embodiment of a process 200 for comparing a new nucleotide or protein sequence with a database of sequences in order to determine the homology levels between the new sequence and the sequences in the database.

FIG. 9 is a flow diagram illustrating one embodiment of a process 200 for comparing a new nucleotide or protein sequence with a database of sequences in order to determine the homology levels between the new sequence and the sequences in the database. The database of sequences can be a private database stored within the computer system 100, or a public database such as GENBANK, PIR or SWISSPROT that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the present invention is a computer system comprising a processor, a data storage device having stored thereon a nucleic acid code of SEQ ID NOs. 38-1756 or a polypeptide code of SEQ ID NOS. 1757-3475, a data storage device having retrievably stored thereon reference nucleotide sequences or polypeptide sequences to be compared to the nucleic acid code of SEQ ID NOs. 38-1756 or polypeptide code of SEQ ID NOS. 1757-3475 and a sequence comparer for conducting the comparison. The sequence comparer may indicate a homology level between the sequences compared or identify structural motifs in the above described nucleic acid code of SEQ ID NOs. 38-1756 and polypeptide codes of SEQ ID NOS. 1757-3475 or it may identify structural motifs in sequences which are compared to these cDNA codes and polypeptide codes. In some embodiments, the data storage device may have stored thereon the sequences of at least 2, 5, 10, 15, 20, 25, 30, or 50 of the cDNA codes of SEQ ID NOs. 38-1756 or polypeptide codes of SEQ ID NOS. 1757-3475.

Another aspect of the present invention is a method for determining the level of homology between a nucleic acid code of SEQ ID NOs. 38-1756 and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading 2, 5, 10, 15, 20, 25, 30, or 50 of the above described cDNA codes of SEQ ID NOs. 38-1756 through use of the computer program and determining homology between the cDNA codes and reference nucleotide sequences.

Figure 10:
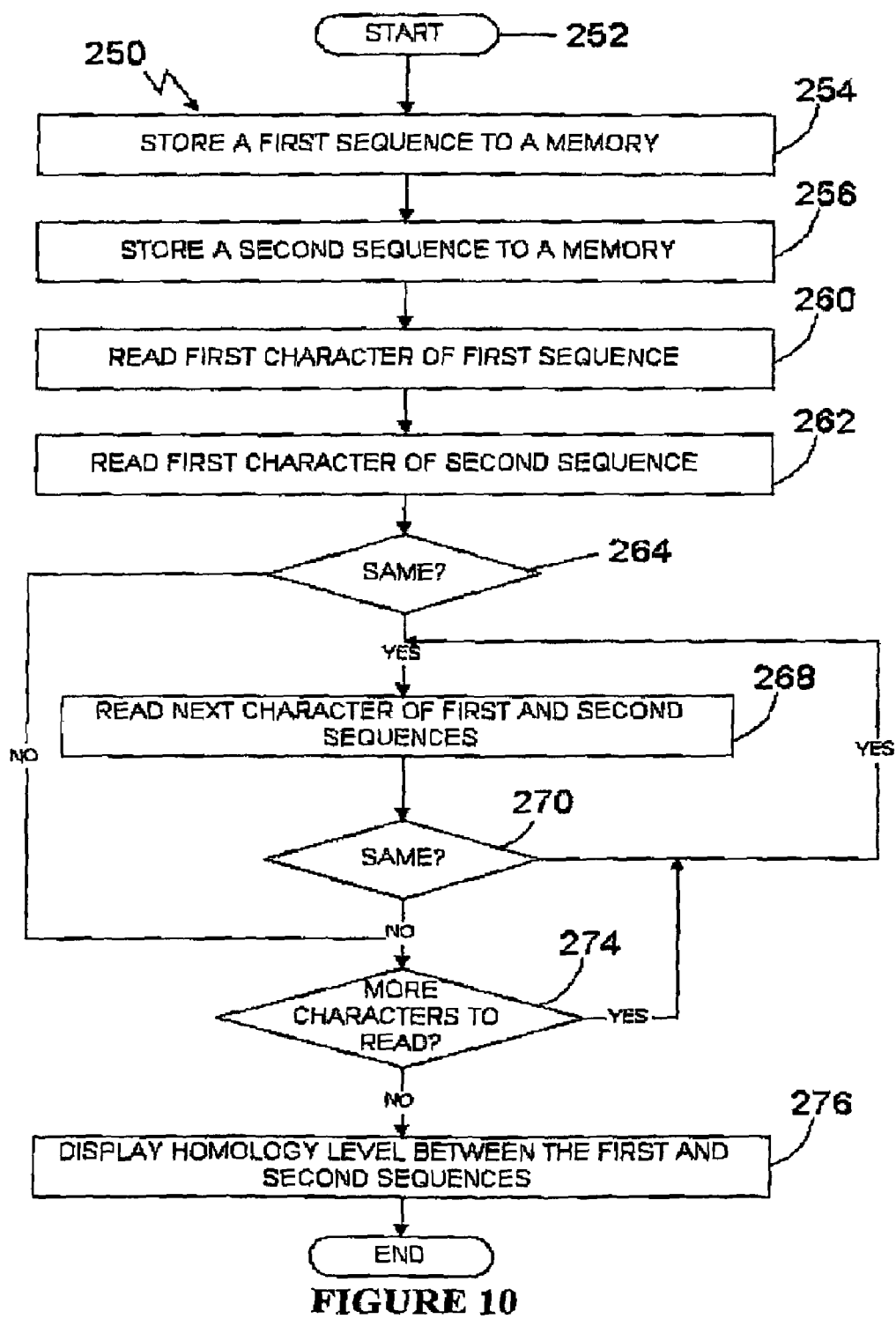
FIG. 10 is a flow diagram illustrating one embodiment of a process 250 in a computer for determining whether two sequences are homologous.

FIG. 10 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made at a decision state 270 whether the next characters are the same. If they are, then the process 250 continues this loop until two characters are not the same. If a determination is made that the next two characters are not the same, the process 250 moves to a decision state 274 to determine whether there are any more characters in either sequence to read.

If there aren't any more characters to read, then the process 250 moves to a state 276 wherein the level of homology between the first and second sequences is displayed to the user. The level of homology is determined by calculating the profragment of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of the cDNA codes of the present invention, to reference nucleotide sequences in order to determine whether the nucleic acid code of SEQ ID NOs. 38-1756 differs from a reference nucleic acid sequence at one or more positions. Optionally such a program records the length and identity of inserted, deleted or substituted nucleotides with respect to the sequence of either the reference polynucleotide or the nucleic acid code of SEQ ID NOs. 38-1756. In one embodiment, the computer program may be a program which determines whether the nucleotide sequences of the cDNA codes of SEQ ID NOs. 38-1756 contain a biallelic marker or single nucleotide polymorphism (SNP) with respect to a reference nucleotide sequence. This single nucleotide polymorphism may comprise a single base substitution, insertion, or deletion, while this biallelic marker may comprise about one to ten consecutive bases substituted, inserted or deleted.

Another aspect of the present invention is a method for determining the level of homology between a polypeptide code of SEQ ID NOS. 1757-3475 and a reference polypeptide sequence, comprising the steps of reading the polypeptide code of SEQ ID NOS. 1757-3475 and the reference polypeptide sequence through use of a computer program which determines homology levels and determining homology between the polypeptide code and the reference polypeptide sequence using the computer program.

Accordingly, another aspect of the present invention is a method for determining whether a nucleic acid code of SEQ ID NOs. 38-1756 differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above and the method illustrated in FIG. 10. The method may also be performed by reading at least 2, 5, 10, 15, 20, 25, 30, or 50 of the cDNA codes of SEQ ID NOs. 38-1756 and the reference nucleotide sequences through the use of the computer program and identifying differences between the cDNA codes and the reference nucleotide sequences with the computer program.

In other embodiments the computer based system may further comprise an identifier for identifying features within the nucleotide sequences of the cDNA codes of SEQ ID NOs. 38-1756 or the amino acid sequences of the polypeptide codes of SEQ ID NOS. 1757-3475.

An "identifier" refers to one or more programs which identifies certain features within the above-described nucleotide sequences of the cDNA codes of SEQ ID NOs. 38-1756 or the amino acid sequences of the polypeptide codes of SEQ ID NOS. 1757-3475. In one embodiment, the identifier may comprise a program which identifies an open reading frame in the cDNAs codes of SEQ ID NOs. 38-1756.

Figure 11:
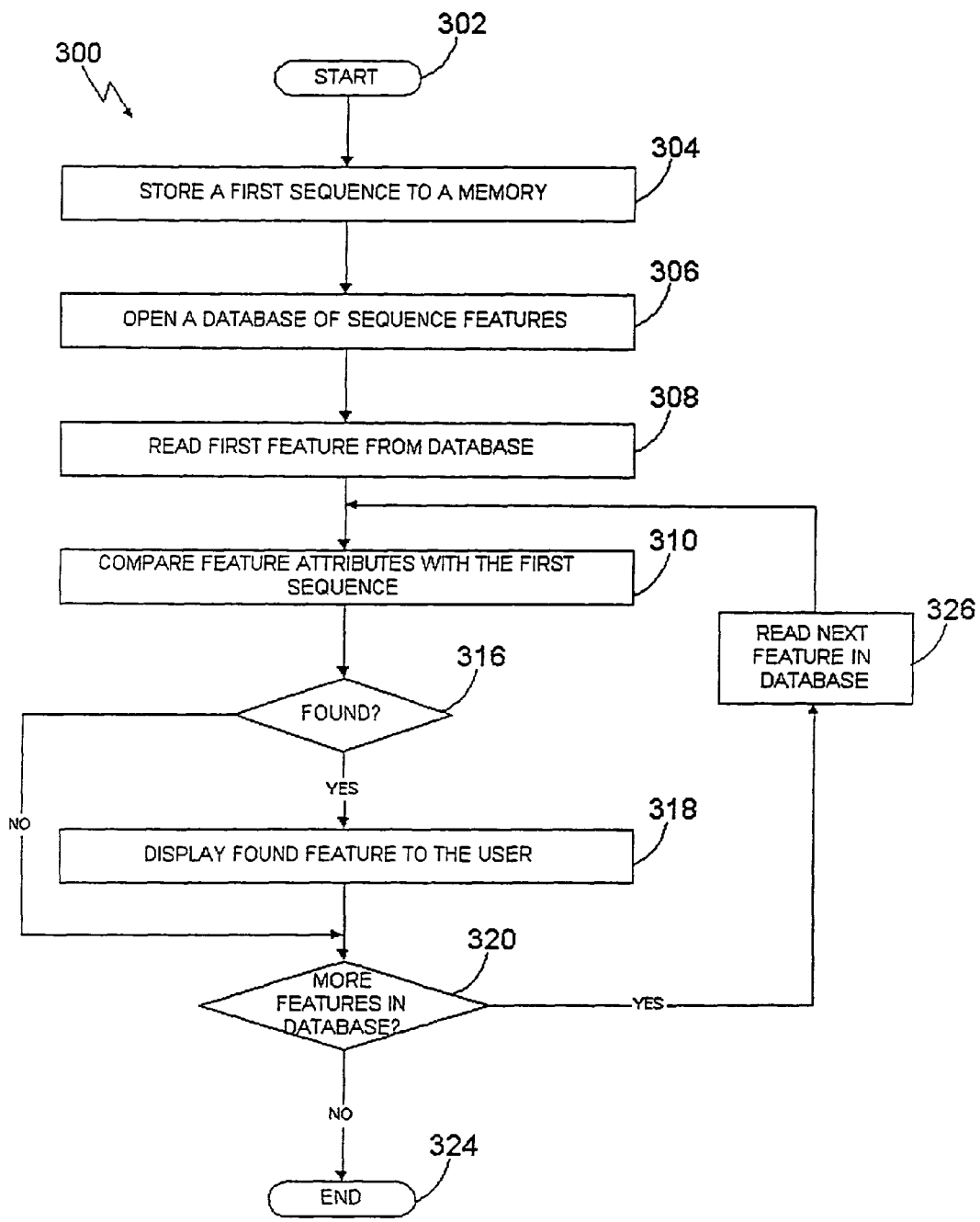
FIG. 11 is a flow diagram illustrating one embodiment of an identifier process 300 for detecting the presence of a feature in a sequence.

FIG. 11 is a flow diagram illustrating one embodiment of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group (www.gcg.com).

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence.

It should be noted, that if the feature attribute is not found in the first sequence at the decision state 316, the process 300 moves directly to the decision state 320 in order to determine if any more features exist in the database.

In another embodiment, the identifier may comprise a molecular modeling program which determines the 3-dimensional structure of the polypeptides codes of SEQ ID NOS. 1757-3475. In some embodiments, the molecular modeling program identifies target sequences that are most compatible with profiles representing the structural environments of the residues in known three-dimensional protein structures. (See, e.g., Eisenberg et al., U.S. Pat. No. 5,436,850 issued Jul. 25, 1995). In another technique, the known three-dimensional structures of proteins in a given family are superimposed to define the structurally conserved regions in that family. This protein modeling technique also uses the known three-dimensional structure of a homologous protein to approximate the structure of the polypeptide codes of SEQ ID NOS. 1757-3475. (See e.g., Srinivasan, et al., U.S. Pat. No. 5,557,535 issued Sep. 17, 1996). Conventional homology modeling techniques have been used routinely to build models of proteases and antibodies. (Sowdhamini et al., Protein Engineering 10:207, 215 (1997)). Comparative approaches can also be used to develop three-dimensional protein models when the protein of interest has poor sequence identity to template proteins. In some cases, proteins fold into similar three-dimensional structures despite having very weak sequence identities. For example, the three-dimensional structures of a number of helical cytokines fold in similar three-dimensional topology in spite of weak sequence homology.

The recent development of threading methods now enables the identification of likely folding patterns in a number of situations where the structural relatedness between target and template(s) is not detectable at the sequence level. Hybrid methods, in which fold recognition is performed using Multiple Sequence Threading (MST), structural equivalencies are deduced from the threading output using a distance geometry program DRAGON to construct a low resolution model, and a full-atom representation is constructed using a molecular modeling package such as QUANTA.

According to this 3-step approach, candidate templates are first identified by using the novel fold recognition algorithm MST, which is capable of performing simultaneous threading of multiple aligned sequences onto one or more 3-D structures. In a second step, the structural equivalencies obtained from the MST output are converted into inter-residue distance restraints and fed into the distance geometry program DRAGON, together with auxiliary information obtained from secondary structure predictions. The program combines the restraints in an unbiased manner and rapidly generates a large number of low resolution model confirmations. In a third step, these low resolution model confirmations are converted into full-atom models and subjected to energy minimization using the molecular modeling package QUANTA. (See e.g., Aszódi et al., Proteins:Structure, Function, and Genetics, Supplement 1:38-42 (1997)).

The results of the molecular modeling analysis may then be used in rational drug design techniques to identify agents which modulate the activity of the polypeptide codes of SEQ ID NOS. 1757-3475.

Accordingly, another aspect of the present invention is a method of identifying a feature within the cDNA codes of SEQ ID NOs. 38-1756 or the polypeptide codes of SEQ ID NOS. 1757-3475 comprising reading the nucleic acid code(s) or the polypeptide code(s) through the use of a computer program which identifies features therein and identifying features within the nucleic acid code(s) or polypeptide code(s) with the computer program. In one embodiment, computer program comprises a computer program which identifies open reading frames. In a further embodiment, the computer program identifies structural motifs in a polypeptide sequence. In another embodiment, the computer program comprises a molecular modeling program. The method may be performed by reading a single sequence or at least 2, 5, 10, 15, 20, 25, 30, or 50 of the cDNA codes of SEQ ID NOs. 38-1756 or the polypeptide codes of SEQ ID NOS. 1757-3475 through the use of the computer program and identifying features within the cDNA codes or polypeptide codes with the computer program.

The cDNA codes of SEQ ID NOs. 38-1756 or the polypeptide codes of SEQ ID NOS. 1757-3475 may be stored and manipulated in a variety of data processor programs in a variety of formats. For example, the cDNA codes of SEQ ID NOs. 38-1756 or the polypeptide codes of SEQ ID NOS. 1757-3475 may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide or polypeptide sequences to be compared to the cDNA codes of SEQ ID NOs. 38-1756 or the polypeptide codes of SEQ ID NOS. 1757-3475. The following list is intended not to limit the invention but to provide guidance to programs and databases which are useful with the cDNA codes of SEQ ID NOs. 38-1756 or the polypeptide codes of SEQ ID NOS. 1757-3475. The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, *J. Mol. Biol.* 215: 403 (1990)), FASTA (Pearson and Lipman, *Proc. Natl. Acad. Sci. USA*, 85: 2444 (1988)), FASTDB (Brutlag et al. Comp. App. Biosci. 6:237-245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the EMBL/ Swissprotein database, the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

EXAMPLE 68

Methods of Making Nucleic Acids

The present invention also comprises methods of making the 5' ESTs (or cDNAs or genomic DNAs obtainable therefrom) of the present invention or fragments thereof. The methods comprise sequentially linking together nucleotides to produce the nucleic acids having the preceding sequences. A variety of methods of synthesizing nucleic acids are known to those skilled in the art.

In many of these methods, synthesis is conducted on a solid support. These included the 3' phosphoramidite methods in which the 3' terminal base of the desired oligonucleotide is immobilized on an insoluble carrier. The nucleotide base to be added is blocked at the 5' hydroxyl and activated at the 3' hydroxyl so as to cause coupling with the immobilized nucleotide base. Deblocking of the new immobilized nucleotide compound and repetition of the cycle will produce the desired polynucleotide. Alternatively, polynucleotides may be prepared as described in U.S. Pat. No. 5,049,656, the disclosure of which is incorporated herein by reference. In some embodiments, several polynucleotides prepared as described above are ligated together to generate longer polynucleotides having a desired sequence.

EXAMPLE 69

Methods of Making Polypeptides

The present invention also comprises methods of making the polynucleotides encoded by the 5' ESTs (or cDNAs or genomic DNAs obtainable therefrom) or fragments thereof. The methods comprise sequentially linking together amino acids to produce the nucleic polypeptides having the preceding sequences. In some embodiments, the polypeptides made by these methods are 150 amino acid or less in length. In other embodiments, the polypeptides made by these methods are 120 amino acids or less in length.

A variety of methods of making polypeptides are known to those skilled in the art, including methods in which the carboxyl terminal amino acid is bound to polyvinyl benzene or another suitable resin. The amino acid to be added possesses blocking groups on its amino moiety and any side chain reactive groups so that only its carboxyl moiety can react. The carboxyl group is activated with carbodiimide or another activating agent and allowed to couple to the immobilized amino acid. After removal of the blocking group, the cycle is repeated to generate a polypeptide having the desired sequence. Alternatively, the methods described in U.S. Pat. No. 5,049,656, the disclosure of which is incorporated herein by reference, may be used.

As discussed above, the 5' ESTs (or cDNAs or genomic DNAs obtainable therefrom) or fragments thereof can be used for various purposes. The polynucleotides can be used to express recombinant protein for analysis, characterization or therapeutic use; production of secreted polypeptides or chimeric polypeptides, antibody production, as markers for tissues in which the corresponding protein is preferentially expressed (either constitutively or at a particular stage of tissue differentiation or development or in disease states); as molecular weight markers on Southern gels; as chromosome markers or tags (when labeled) to identify chromosomes or to map related gene positions; to compare with endogenous DNA sequences in patients to identify potential genetic disorders; as probes to hybridize and thus discover novel, related DNA sequences; as a source of information to derive PCR primers for genetic fingerprinting; for selecting and making oligomers for attachment to a "gene chip" or other support, including for examination for expression patterns; to raise anti-protein antibodies using DNA immunization techniques; and as an antigen to raise anti-DNA antibodies or elicit another immune response. Where the polynucleotide encodes a protein or polypeptide which binds or potentially binds to another protein or polypeptide (such as, for example, in a receptor-ligand interaction), the polynucleotide can also be used in interaction trap assays (such as, for example, that described in Gyuris et al., *Cell* 75:791-803 (1993), the disclosure of which is hereby incorporated by reference) to identify polynucleotides encoding the other protein or polypeptide with which binding occurs or to identify inhibitors of the binding interaction.

The proteins or polypeptides provided by the present invention can similarly be used in assays to determine biological activity, including in a panel of multiple proteins for high-throughput screening; to raise antibodies or to elicit another immune response; as a reagent (including the labeled reagent) in assays designed to quantitatively detennine levels of the protein (or its receptor) in biological fluids; as markers for tissues in which the corresponding protein is preferentially expressed (either constitutively or at a particular stage of tissue differentiation or development or in a disease state); and, of course, to isolate correlative receptors or ligands. Where the protein or polypeptide binds or potentially binds to another protein or polypeptide (such as, for example, in a receptor-ligand interaction), the protein can be used to identify the other protein with which binding occurs or to identify inhibitors of the binding interaction. Proteins or polypeptides involved in these binding interactions can also be used to screen for peptide or small molecule inhibitors or agonists of the binding interaction.

Any or all of these research utilities are capable of being developed into reagent grade or kit format for commercialization as research products.

Methods for performing the uses listed above are well known to those skilled in the art. References disclosing such methods include without limitation "Molecular Cloning; A Laboratory Manual", 2d ed., Cold Spring Harbor Laboratory Press, Sambrook, J., E. F. Fritsch and T. Maniatis eds., 1989, and "Methods in Enzymology; Guide to Molecular Cloning Techniques", Academic Press, Berger, S. L. and A. R. Kimmel eds., 1987.

Polynucleotides and proteins or polypeptides of the present invention can also be used as nutritional sources or supplements. Such uses include without limitation use as a protein or amino acid supplement, use as a carbon source, use as a nitrogen source and use as a source of carbohydrate. In such cases the protein or polynucleotide of the invention can be added to the feed of a particular organism or can be administered as a separate solid or liquid preparation, such as in the form of powder, pills, solutions, suspensions or capsules. In the case of microorganisms, the protein or polynucleotide of the invention can be added to the medium in or on which the microorganism is cultured.

Although this invention has been described in terms of certain preferred embodiments, other embodiments which will be apparent to those of ordinary skill in the art in view of the disclosure herein are also within the scope of this invention. Accordingly, the scope of the invention is intended to be defined only by reference to the appended claims. All documents cited herein are incorporated herein by reference in their entirety.

TABLE I

Parameters used for each step of EST analysis

| Step | Search Characteristics | | | Selection Characteristics | |
|---|---|---|---|---|---|
| | Program | Strand | Parameters | Identity (%) | Length (bp) |
| Miscellaneous | blastn | both | S = 61 X = 16 | 90 | 17 |
| tRNA | fasta | both | — | 80 | 60 |
| rRNA | blastn | both | S = 108 | 80 | 40 |
| mtRNA | blastn | both | S = 108 | 80 | 40 |
| Procaryotic | blastn | both | S = 144 | 90 | 40 |
| Fungal | blastn | both | S = 144 | 90 | 40 |
| Alu | fasta* | both | — | 70 | 40 |

TABLE I-continued

Parameters used for each step of EST analysis

| Step | Search Characteristics | | | Selection Characteristics | |
|---|---|---|---|---|---|
| | Program | Strand | Parameters | Identity (%) | Length (bp) |
| L1 | blastn | both | S = 72 | 70 | 40 |
| Repeats | blastn | both | S = 72 | 70 | 40 |
| Promoters | blastn | top | S = 54 X = 16 | 90 | 15⊥ |
| Vertebrate | fasta* | both | S = 108 | 90 | 30 |
| ESTs | blatsn | both | S = 108 X = 16 | 90 | 30 |
| Proteins | blastxη | top | E = 0.001 | — | — |

*use "Quick Fast" Database Scanner
⊥alignment further constrained to begin closer than 10 bp to EST\5' end
ηusing BLOSUM62 substitution matrix

TABLE II

| SEQ. ID NO. | CATEGORY | VON HEIJNE SCORE | TISSUE SOURCE | INTERNAL DESIGNATION |
|---|---|---|---|---|
| ID38 | new | 10.8 | Brain | 33-19-2-H2-PU |
| ID39 | new | 10.8 | Brain | 33-56-1-E8-PU |
| ID40 | new | 10 | Brain | 33-79-3-D12-PU |
| ID41 | new | 9.6 | Brain | 33-72-2-B2-PU |
| ID42 | new | 9.5 | Brain | 33-13-2-B9-PU |
| ID43 | new | 9.1 | Brain | 33-113-1-E9-PU |
| ID44 | new | 9 | Brain | 33-28-4-E8-PU |
| ID45 | new | 8.8 | Brain | 33-12-3-F2-PU |
| ID46 | new | 8.8 | Brain | 33-70-1-C11-PU |
| ID47 | new | 8.5 | Brain | 33-74-1-B2-PU |
| ID48 | new | 8.5 | Brain | 33-29-3-F1-PU |
| ID49 | new | 8.4 | Brain | 33-8-2-A1-PU |
| ID50 | new | 8.3 | Brain | 17-17-3-A9-PU |
| ID51 | new | 8.3 | Brain | 33-106-2-A8-PU |
| ID52 | new | 8.3 | Brain | 33-112-4-E7-PU |
| ID53 | new | 8.2 | Brain | 33-98-1-E6-PU |
| ID54 | new | 8.2 | Brain | 33-76-1-B6-PU |
| ID55 | new | 8 | Brain | 33-35-4-G8-PU |
| ID56 | new | 7.9 | Brain | 33-17-3-E4-PU |
| ID57 | new | 7.9 | Brain | 33-110-4-B5-PU |
| ID58 | new | 7.8 | Brain | 33-40-1-A11-PU |
| ID59 | new | 7.7 | Brain | 33-71-1-A8-PU |
| ID60 | new | 7.7 | Brain | 33-96-3-G7-PU |
| ID61 | new | 7.6 | Brain | 33-112-3-D12-PU |
| ID62 | new | 7.6 | Brain | 33-62-2-B3-PU |
| ID63 | new | 7.6 | Brain | 33-6-4-G6-PU |
| ID64 | new | 7.5 | Brain | 33-82-4-E2-PU |
| ID65 | new | 7.4 | Brain | 23-81-3-H11-PU |
| ID66 | new | 7.3 | Brain | 33-64-1-B4-PU |
| ID67 | new | 7.2 | Brain | 33-31-1-B12-PU |
| ID68 | new | 7 | Brain | 33-24-4-F9-PU |
| ID69 | new | 7 | Brain | 33-110-3-E9-PU |
| ID70 | new | 7 | Brain | 33-4-2-G5-PU |
| ID71 | new | 6.9 | Brain | 33-74-2-A4-PU |
| ID72 | new | 6.9 | Brain | 33-52-4-F9-PU |
| ID73 | new | 6.9 | Brain | 33-74-1-B11-PU |
| ID74 | new | 6.8 | Brain | 33-10-4-D9-PU |
| ID75 | new | 6.8 | Brain | 33-15-2-H3-PU |
| ID76 | new | 6.7 | Brain | 33-38-2-D5-PU |
| ID77 | new | 6.7 | Brain | 33-78-3-D2-PU |
| ID78 | new | 6.7 | Brain | 33-96-3-D3-PU |
| ID79 | new | 6.6 | Brain | 33-76-4-B11-PU |
| ID80 | new | 6.3 | Brain | 33-39-1-C6-PU |
| ID81 | new | 6.1 | Brain | 33-106-3-B12-PU |
| ID82 | new | 6 | Brain | 33-4-2-B7-PU |
| ID83 | new | 5.9 | Brain | 33-99-2-E4-PU |
| ID84 | new | 5.9 | Brain | 33-34-1-B1-PU |
| ID85 | new | 5.8 | Brain | 33-67-4-E9-PU |
| ID86 | new | 5.7 | Brain | 33-11-3-H11-PU |
| ID87 | new | 5.6 | Brain | 33-13-2-A8-PU |

TABLE II-continued

| SEQ. ID NO. | CATEGORY | VON HEIJNE SCORE | TISSUE SOURCE | INTERNAL DESIGNATION |
|---|---|---|---|---|
| ID88 | new | 5.6 | Brain | 33-83-4-B6-PU |
| ID89 | new | 5.6 | Brain | 33-70-1-E4-PU |
| ID90 | new | 5.6 | Brain | 33-5-3-H11-PU |
| ID91 | new | 5.6 | Brain | 33-10-3-G5-PU |
| ID92 | new | 5.5 | Brain | 33-97-4-G4-PU |
| ID93 | new | 5.5 | Brain | 33-46-4-F4-PU |
| ID94 | new | 5.4 | Brain | 33-4-1-G11-PU |
| ID95 | new | 5.3 | Brain | 33-105-1-H5-PU |
| ID96 | new | 5.3 | Brain | 33-74-2-B10-PU |
| ID97 | new | 5.3 | Brain | 33-49-3-E5-PU |
| ID98 | new | 5.3 | Brain | 33-114-2-A1-PU |
| ID99 | new | 5.2 | Brain | 33-71-1-G12-PU |
| ID100 | new | 5.2 | Brain | 33-47-3-E6-PU |
| ID101 | new | 5.2 | Brain | 33-1-2-E8-PU |
| ID102 | new | 5.2 | Brain | 33-93-4-E12-PU |
| ID103 | new | 5.1 | Brain | 33-1-2-H1-PU |
| ID104 | new | 5.1 | Brain | 17-10-1-H8-PU |
| ID105 | new | 5 | Brain | 33-110-2-B8-PU |
| ID106 | new | 5 | Brain | 33-104-3-D9-PU |
| ID107 | new | 5 | Brain | 33-72-2-H11-PU |
| ID108 | new | 4.9 | Brain | 33-7-4-D6-PU |
| ID109 | new | 4.9 | Brain | 33-31-4-G2-PU |
| ID110 | new | 4.9 | Brain | 33-109-1-E8-PU |
| ID111 | new | 4.8 | Brain | 17-1-2-B11-PU |
| ID112 | new | 4.8 | Brain | 33-19-4-H3-PU |
| ID113 | new | 4.8 | Brain | 33-14-4-E1-PU |
| ID114 | new | 4.8 | Brain | 33-70-3-H1-PU |
| ID115 | new | 4.7 | Brain | 33-86-4-H10-PU |
| ID116 | new | 4.7 | Brain | 33-107-3-D5-PU |
| ID117 | new | 4.7 | Brain | 33-23-4-B9-PU |
| ID118 | new | 4.7 | Brain | 33-82-4-H5-PU |
| ID119 | new | 4.6 | Brain | 33-16-3-F4-PU |
| ID120 | new | 4.6 | Brain | 33-97-4-C5-PU |
| ID121 | new | 4.6 | Brain | 33-100-3-B10-PU |
| ID122 | new | 4.6 | Brain | 33-59-3-E3-PU |
| ID123 | new | 4.5 | Brain | 33-25-1-G2-PU |
| ID124 | new | 4.5 | Brain | 17-16-3-B2-PU |
| ID125 | new | 4.4 | Brain | 33-52-4-E7-PU |
| ID126 | new | 4.4 | Brain | 33-91-1-D1-PU |
| ID127 | new | 4.4 | Brain | 33-26-1-B9-PU |
| ID128 | new | 4.4 | Brain | 33-97-3-H6-PU |
| ID129 | new | 4.4 | Brain | 33-109-2-E8-PU |
| ID130 | new | 4.3 | Brain | 33-59-2-B7-PU |
| ID131 | new | 4.3 | Brain | 33-28-4-D1-PU |
| ID132 | new | 4.3 | Brain | 33-29-4-E2-PU |
| ID133 | new | 4.1 | Brain | 33-70-1-H6-PU |
| ID134 | new | 4.1 | Brain | 33-7-1-B2-PU |
| ID135 | new | 4.1 | Brain | 33-52-4-F8-PU |
| ID136 | new | 4.1 | Brain | 33-23-2-A6-PU |
| ID137 | new | 4.1 | Brain | 33-39-3-E5-PU |
| ID138 | new | 4.1 | Brain | 33-81-4-H6-PU |
| ID139 | new | 4.1 | Brain | 33-105-3-F5-PU |
| ID140 | new | 4 | Brain | 33-35-2-H11-PU |
| ID141 | new | 4 | Brain | 33-50-3-E12-PU |
| ID142 | new | 4 | Brain | 33-16-3-H7-PU |
| ID143 | new | 4 | Brain | 33-79-2-H4-PU |
| ID144 | new | 3.9 | Brain | 33-32-4-B12-PU |
| ID145 | new | 3.9 | Brain | 33-110-4-A5-PU |
| ID146 | new | 3.9 | Brain | 33-109-2-H1-PU |
| ID147 | new | 3.9 | Brain | 33-100-1-E6-PU |
| ID148 | new | 3.9 | Brain | 33-78-2-E7-PU |
| ID149 | new | 3.9 | Brain | 33-82-4-G3-PU |
| ID150 | new | 3.9 | Brain | 17-1-1-A9-PU |
| ID151 | new | 3.9 | Brain | 33-89-4-E1-PU |
| ID152 | new | 3.9 | Brain | 33-89-1-B4-PU |
| ID153 | new | 3.9 | Brain | 33-96-3-A3-PU |
| ID154 | new | 3.8 | Brain | 33-92-3-D1-PU |
| ID155 | new | 3.8 | Brain | 33-104-4-H4-PU |
| ID156 | new | 3.8 | Brain | 33-106-1-B8-PU |
| ID157 | new | 3.6 | Brain | 33-1-3-D1-PU |
| ID158 | new | 3.6 | Brain | 33-40-2-F5-PU |
| ID159 | new | 3.6 | Brain | 33-4-1-E8-PU |
| ID160 | new | 3.6 | Brain | 33-36-3-E2-PU |
| ID161 | new | 3.6 | Brain | 17-18-3-A6-PU |
| ID162 | new | 3.6 | Brain | 33-12-1-B1-PU |
| ID163 | new | 3.6 | Brain | 33-29-1-H1-PU |

TABLE II-continued

| SEQ. ID NO. | CATEGORY | VON HEIJNE SCORE | TISSUE SOURCE | INTERNAL DESIGNATION |
|---|---|---|---|---|
| ID164 | new | 3.6 | Brain | 33-103-1-E1-PU |
| ID165 | new | 3.5 | Brain | 33-10-4-H2-PU |
| ID166 | new | 3.5 | Brain | 33-25-1-H2-PU |
| ID167 | new | 3.5 | Brain | 33-10-4-G2-PU |
| ID168 | new | 3.5 | Brain | 33-67-1-F4-PU |
| ID169 | ext-est-not-vrt | 12.5 | Brain | 33-77-4-E2-PU |
| ID170 | ext-est-not-vrt | 10.1 | Brain | 33-31-3-C11-PU |
| ID171 | ext-est-not-vrt | 9.8 | Brain | 33-28-2-H7-PU |
| ID172 | ext-est-not-vrt | 9.2 | Brain | 33-112-3-C8-PU |
| ID173 | ext-est-not-vrt | 7.9 | Brain | 33-23-3-A11-PU |
| ID174 | ext-est-not-vrt | 7.9 | Brain | 33-29-2-E11-PU |
| ID175 | ext-est-not-vrt | 7.9 | Brain | 33-66-4-C7-PU |
| ID176 | ext-est-not-vrt | 7.1 | Brain | 33-78-1-D7-PU |
| ID177 | ext-est-not-vrt | 6.6 | Brain | 33-31-3-D7-PU |
| ID178 | ext-est-not-vrt | 6.3 | Brain | 33-19-1-C11-PU |
| ID179 | ext-est-not-vrt | 6 | Brain | 33-67-1-A5-PU |
| ID180 | ext-est-not-vrt | 5.9 | Brain | 33-58-3-C8-PU |
| ID181 | ext-est-not-vrt | 4.9 | Brain | 33-107-4-C3-PU |
| ID182 | ext-est-not-vrt | 4.9 | Brain | 33-7-2-G12-PU |
| ID183 | ext-est-not-vrt | 4.8 | Brain | 33-11-1-G5-PU |
| ID184 | ext-est-not-vrt | 4.7 | Brain | 33-31-4-D9-PU |
| ID185 | ext-est-not-vrt | 4.6 | Brain | 33-26-4-E10-PU |
| ID186 | ext-est-not-vrt | 4.5 | Brain | 33-70-4-F7-PU |
| ID187 | ext-est-not-vrt | 4.5 | Brain | 33-19-2-D1-PU |
| ID188 | ext-est-not-vrt | 4.4 | Brain | 33-48-4-F8-PU |
| ID189 | ext-est-not-vrt | 4.3 | Brain | 33-109-3-B10-PU |
| ID190 | ext-est-not-vrt | 4.1 | Brain | 33-30-2-A6-PU |
| ID191 | ext-est-not-vrt | 3.8 | Brain | 33-75-3-D7-PU |
| ID192 | ext-est-not-vrt | 3.7 | Brain | 33-109-4-C1-PU |
| ID193 | est-not-ext | 10.5 | Brain | 33-97-3-D4-PU |
| ID194 | est-not-ext | 10.1 | Brain | 33-61-2-F6-PU |
| ID195 | est-not-ext | 9.5 | Brain | 33-54-1-B9-PU |
| ID196 | est-not-ext | 9.3 | Brain | 33-39-4-D1-PU |
| ID197 | est-not-ext | 9.1 | Brain | 33-57-4-H5-PU |
| ID198 | est-not-ext | 9 | Brain | 33-60-2-B3-PU |
| ID199 | est-not-ext | 8.6 | Brain | 33-52-1-A1-PU |
| ID200 | est-not-ext | 8.4 | Brain | 33-82-2-H10-PU |
| ID201 | est-not-ext | 7.5 | Brain | 33-79-4-B11-PU |
| ID202 | est-not-ext | 7.5 | Brain | 33-18-3-H3-PU |
| ID203 | est-not-ext | 7.5 | Brain | 33-21-1-D6-PU |
| ID204 | est-not-ext | 7.4 | Brain | 33-17-3-F9-PU |
| ID205 | est-not-ext | 7.4 | Brain | 33-70-2-G3-PU |
| ID206 | est-not-ext | 7.4 | Brain | 33-89-3-H4-PU |
| ID207 | est-not-ext | 7.4 | Brain | 33-46-3-E10-PU |
| ID208 | est-not-ext | 7 | Brain | 33-36-2-F9-PU |
| ID209 | est-not-ext | 6.8 | Brain | 33-39-1-C4-PU |
| ID210 | est-not-ext | 6.8 | Brain | 33-65-4-C6-PU |
| ID211 | est-not-ext | 6.4 | Brain | 33-18-2-G6-PU |
| ID212 | est-not-ext | 6.4 | Brain | 33-36-3-C6-PU |
| ID213 | est-not-ext | 6 | Brain | 33-79-2-B6-PU |
| ID214 | est-not-ext | 5.9 | Brain | 33-71-4-D11-PU |
| ID215 | est-not-ext | 5.9 | Brain | 17-12-2-A3-PU |
| ID216 | est-not-ext | 5.9 | Brain | 33-95-1-A12-PU |
| ID217 | est-not-ext | 5.8 | Brain | 33-5-3-E3-PU |
| ID218 | est-not-ext | 5.8 | Brain | 33-74-2-D3-PU |
| ID219 | est-not-ext | 5.7 | Brain | 33-50-3-H8-PU |
| ID220 | est-not-ext | 5.6 | Brain | 33-19-1-A2-PU |
| ID221 | est-not-ext | 5.5 | Brain | 33-22-1-D3-PU |
| ID222 | est-not-ext | 5.5 | Brain | 33-97-1-G4-PU |
| ID223 | est-not-ext | 5.4 | Brain | 33-65-4-D10-PU |
| ID224 | est-not-ext | 5.4 | Brain | 33-79-4-C4-PU |
| ID225 | est-not-ext | 5.3 | Brain | 33-20-2-C5-PU |
| ID226 | est-not-ext | 5.2 | Brain | 33-34-4-A5-PU |
| ID227 | est-not-ext | 5.2 | Brain | 33-6-2-F11-PU |
| ID228 | est-not-ext | 5.2 | Brain | 33-2-2-G5-PU |
| ID229 | est-not-ext | 5.1 | Brain | 33-98-1-G7-PU |
| ID230 | est-not-ext | 5.1 | Brain | 33-20-3-B10-PU |
| ID231 | est-not-ext | 5 | Brain | 33-106-2-D9-PU |
| ID232 | est-not-ext | 4.9 | Brain | 33-72-2-A9-PU |
| ID233 | est-not-ext | 4.9 | Brain | 33-83-3-G8-PU |
| ID234 | est-not-ext | 4.8 | Brain | 33-31-3-E6-PU |
| ID235 | est-not-ext | 4.7 | Brain | 33-28-4-E2-PU |
| ID236 | est-not-ext | 4.6 | Brain | 33-101-3-F4-PU |
| ID237 | est-not-ext | 4.6 | Brain | 33-98-4-C1-PU |
| ID238 | est-not-ext | 4.5 | Brain | 33-31-2-E11-PU |
| ID239 | est-not-ext | 4.5 | Brain | 33-26-2-B6-PU |

TABLE II-continued

| SEQ. ID NO. | CATEGORY | VON HEIJNE SCORE | TISSUE SOURCE | INTERNAL DESIGNATION |
|---|---|---|---|---|
| ID240 | est-not-ext | 4.4 | Brain | 33-75-4-H7-PU |
| ID241 | est-not-ext | 4.3 | Brain | 33-13-1-C6-PU |
| ID242 | est-not-ext | 4.3 | Brain | 33-35-4-G1-PU |
| ID243 | est-not-ext | 4.3 | Brain | 33-76-3-G11-PU |
| ID244 | est-not-ext | 4.2 | Brain | 33-72-1-A3-PU |
| ID245 | est-not-ext | 4.2 | Brain | 33-71-2-A2-PU |
| ID246 | est-not-ext | 4.2 | Brain | 33-23-3-H10-PU |
| ID247 | est-not-ext | 4.2 | Brain | 33-13-1-C1-PU |
| ID248 | est-not-ext | 4.2 | Brain | 33-43-2-G12-PU |
| ID249 | est-not-ext | 4.2 | Brain | 33-91-4-E10-PU |
| ID250 | est-not-ext | 4.1 | Brain | 33-113-2-B8-PU |
| ID251 | est-not-ext | 4 | Brain | 33-104-3-G9-PU |
| ID252 | est-not-ext | 3.9 | Brain | 33-66-2-B10-PU |
| ID253 | est-not-ext | 3.9 | Brain | 33-1-2-E9-PU |
| ID254 | est-not-ext | 3.9 | Brain | 33-51-1-G7-PU |
| ID255 | est-not-ext | 3.9 | Brain | 33-32-3-D11-PU |
| ID256 | est-not-ext | 3.8 | Brain | 33-43-2-H10-PU |
| ID257 | est-not-ext | 3.8 | Brain | 33-48-4-H11-PU |
| ID258 | est-not-ext | 3.8 | Brain | 33-8-4-C5-PU |
| ID259 | est-not-ext | 3.8 | Brain | 33-24-1-F5-PU |
| ID260 | est-not-ext | 3.8 | Brain | 33-70-1-A9-PU |
| ID261 | est-not-ext | 3.8 | Brain | 33-30-4-C4-PU |
| ID262 | est-not-ext | 3.8 | Brain | 33-10-2-G7-PU |
| ID263 | est-not-ext | 3.6 | Brain | 33-18-4-E12-PU |
| ID264 | est-not-ext | 3.6 | Brain | 33-52-1-G7-PU |
| ID265 | est-not-ext | 3.6 | Brain | 33-57-1-H10-PU |
| ID266 | est-not-ext | 3.5 | Brain | 33-80-3-E2-PU |
| ID267 | est-not-ext | 3.5 | Brain | 33-36-1-D3-PU |
| ID268 | ext-vrt-not-genomic | 11.3 | Brain | 33-101-1-A2-PU |
| ID269 | ext-vrt-not-genomic | 6.6 | Brain | 33-55-2-E8-PU |
| ID270 | ext-vrt-not-genomic | 4.8 | Brain | 33-14-2-H3-PU |
| ID271 | new | 15 | Liver<br>Fetal liver | 22-6-1-A10-PU |
| ID272 | new | 13.2 | Ovary<br>Hypertrophic prostate<br>Brain | 77-16-3-B7-PU |
| ID273 | new | 13.1 | Fetal brain<br>Substantia nigra | 47-47-1-F2-PU |
| ID274 | new | 11.6 | Fetal kidney<br>Cancerous prostate | 58-12-2-E11-PU |
| ID275 | new | 10.7 | Liver<br>Kidney | 21-4-2-D1-PU |
| ID276 | new | 9.6 | Hypertrophic prostate<br>Cancerous prostate<br>Large intestine | 77-38-4-B2-PU |
| ID277 | new | 9.4 | Fetal kidney<br>Cancerous prostate | 76-10-2-B7-PU |
| ID278 | new | 9.4 | Prostate<br>Brain | 33-99-2-G8-PU |
| ID279 | new | 9.1 | Hypertrophic prostate<br>Normal prostate<br>Brain | 78-32-2-C2-PU |
| ID280 | new | 9.1 | Ovary<br>Brain | 26-40-3-D6-PU |
| ID281 | new | 8 | Fetal kidney<br>Brain | 33-106-2-F10-PU |
| ID282 | new | 7.8 | Fetal kidney<br>Lung (cells) | 58-38-1-A2-PU |
| ID283 | new | 7.4 | Lymph ganglia<br>Surrenals | 62-10-3-A11-PU |
| ID284 | new | 7.4 | Hypertrophic prostate<br>Cancerous prostate | 76-45-1-F5-PU |
| ID285 | new | 7.1 | Fetal kidney<br>Lung (cells)<br>Umbilical cord<br>Hypertrophic prostate<br>Cancerous prostate<br>Substantia nigra | 37-10-3-D7-PU |
| ID286 | new | 6.9 | Hypertrophic prostate<br>Normal prostate<br>Lymph ganglia<br>Spleen | 78-16-2-B12-PU |
| ID287 | new | 6.8 | Fetal brain<br>Brain | 33-38-2-A4-PU |

TABLE II-continued

| SEQ. ID NO. | CATEGORY | VON HEIJNE SCORE | TISSUE SOURCE | INTERNAL DESIGNATION |
|---|---|---|---|---|
| ID288 | new | 6.7 | Heart<br>Spleen<br>Substantia nigra | 47-25-4-A2-PU |
| ID289 | new | 6.3 | Fetal brain<br>Spleen | 20-10-3-D9-PU |
| ID290 | new | 6.3 | Hypertrophic prostate<br>Thyroid | 84-5-1-C9-PU |
| ID291 | new | 6.3 | Prostate<br>Hypertrophic prostate<br>Normal prostate<br>Cancerous prostate | 76-40-1-A8-PU |
| ID292 | new | 6.3 | Fetal kidney<br>Normal prostate<br>Hypertrophic prostate<br>Cancerous prostate | 76-5-1-F4-PU |
| ID293 | new | 6.3 | Fetal kidney<br>Hypertrophic prostate<br>Kidney | 77-25-3-H5-PU |
| ID294 | new | 5.7 | Prostate<br>Lymph ganglia<br>Lung | 42-1-4-H1-PU |
| ID295 | new | 5.6 | Brain<br>Lymph ganglia<br>Pancreas | 33-80-4-E4-PU |
| ID296 | new | 5.6 | Fetal kidney<br>Normal prostate | 58-47-2-E11-PU |
| ID297 | new | 5.6 | Muscle<br>Brain | 33-56-4-F4-PU |
| ID298 | new | 5.5 | Placenta<br>Lung (cells)<br>Colon<br>Cancerous prostate | 23-1-4-F6-PU |
| ID299 | new | 5.3 | Normal prostate<br>Cancerous prostate | 76-44-2-F7-PU |
| ID300 | new | 5.2 | Hypertrophic prostate<br>Cancerous prostate | 76-19-1-E9-PU |
| ID301 | new | 5.1 | Colon<br>Normal prostate<br>Kidney | 78-31-1-D12-PU |
| ID302 | new | 4.9 | Prostate<br>Spleen | 20-1-4-H6-PU |
| ID303 | new | 4.9 | Lymphocytes<br>Cancerous prostate | 24-3-4-C4-PU |
| ID304 | new | 4.7 | Kidney<br>Brain | 33-102-2-C9-PU |
| ID305 | new | 4.7 | Colon<br>Lymph ganglia | 48-47-3-A5-PU |
| ID306 | new | 4.6 | Placenta<br>Hypertrophic prostate | 77-2-3-D1-PU |
| ID307 | new | 4.6 | Normal prostate<br>Thyroid<br>Cancerous prostate<br>Substantia nigra | 76-3-3-C7-PU |
| ID308 | new | 4.5 | Fetal kidney<br>Large intestine | 83-1-3-H6-PU |
| ID309 | new | 4.4 | Fetal brain<br>Brain | 33-7-2-D11-PU |
| ID310 | new | 4 | Normal prostate<br>Substantia nigra | 78-28-2-G12-PU |
| ID311 | new | 3.9 | Normal prostate<br>Cancerous prostate | 76-23-3-D8-PU |
| ID312 | new | 3.9 | Heart<br>Lymph ganglia | 48-3-3-H9-PU |
| ID313 | new | 3.8 | Brain<br>Lung | 42-2-4-B8-PU |
| ID314 | new | 3.8 | Normal prostate<br>Hypertrophic prostate | 77-37-2-H1-PU |
| ID315 | new | 3.8 | Lung (cells)<br>Testis<br>Lung | 51-37-4-B1-PU |
| ID316 | new | 3.7 | Ovary<br>Lung (cells)<br>Colon<br>Normal prostate | 23-9-4-G9-PU |

TABLE II-continued

| SEQ. ID NO. | CATEGORY | VON HEIJNE SCORE | TISSUE SOURCE | INTERNAL DESIGNATION |
|---|---|---|---|---|
| ID317 | new | 3.5 | Ovary<br>Muscle<br>Hypertrophic prostate | 27-3-2-B6-PU |
| ID318 | new | 3.5 | Normal prostate<br>Hypertrophic prostate<br>Cancerous prostate | 76-30-3-B7-PU |
| ID319 | ext-est-not-vrt | 13.4 | Ovary<br>Prostate<br>Cancerous prostate | 76-9-4-G9-PU |
| ID320 | ext-est-not-vrt | 12.6 | Normal prostate<br>Hypertrophic prostate | 78-25-4-H1-PU |
| ID321 | ext-est-not-vrt | 11.8 | Fetal kidney<br>Hypertrophic prostate | 77-1-4-D10-PU |
| ID322 | ext-est-not-vrt | 11.2 | Lung (cells)<br>Normal prostate<br>Cancerous prostate | 78-37-1-A12-PU |
| ID323 | ext-est-not-vrt | 10.3 | Umbilical cord<br>Hypertrophic prostate | 37-10-2-C10-PU |
| ID324 | ext-est-not-vrt | 10.1 | Brain<br>Cancerous prostate | 76-16-1-H5-PU |
| ID325 | ext-est-not-vrt | 9.8 | Lymphocytes<br>Lung (cells)<br>Umbilical cord<br>Normal prostate | 24-1-4-G11-PU |
| ID326 | ext-est-not-vrt | 9.3 | Thyroid<br>Heart<br>Lymph ganglia<br>Lung | 48-51-2-C10-PU |
| ID327 | ext-est-not-vrt | 8.4 | | 33-97-4-G8-PU |
| ID328 | ext-est-not-vrt | 7.8 | Fetal brain<br>Brain | 33-22-1-F9-PU |
| ID329 | ext-est-not-vrt | 7.4 | Ovary<br>Liver<br>Umbilical cord<br>Kidney<br>Surrenals | 37-7-4-E7-PU |
| ID330 | ext-est-not-vrt | 7.2 | Muscle<br>Liver<br>Dystrophic muscle<br>Normal prostate<br>Testis<br>Cancerous prostate<br>Lymph ganglia<br>Large intestine | 27-12-3-H8-PU |
| ID331 | ext-est-not-vrt | 7.1 | Fetal kidney<br>Ovary | 58-23-4-G9-PU |
| ID332 | ext-est-not-vrt | 6.9 | Placenta<br>Fetal kidney | 58-34-2-H8-PU |
| ID333 | ext-est-not-vrt | 6.7 | Fetal kidney<br>Fetal brain<br>Umbilical cord<br>Heart<br>Fetal liver | 37-9-1-D4-PU |
| ID334 | ext-est-not-vrt | 6.6 | Fetal kidney<br>Liver<br>Thyroid<br>Kidney<br>Cancerous prostate<br>Lung (cells)<br>Normal prostate<br>Lymph ganglia | 58-5-3-A8-PU |
| ID335 | ext-est-not-vrt | 6.6 | Cancerous prostate<br>Normal prostate | 76-35-1-A11-PU |
| ID336 | ext-est-not-vrt | 5.4 | Hypertrophic prostate<br>Lung (cells) | 77-35-2-E10-PU |
| ID337 | ext-est-not-vrt | 5.4 | Fetal kidney<br>Fetal brain<br>Normal prostate | 58-52-4-D8-PU |
| ID338 | ext-est-not-vrt | 5.3 | Cancerous prostate<br>Substantia nigra | 47-26-3-D2-PU |
| ID339 | ext-est-not-vrt | 5.1 | Cancerous prostate<br>Fetal brain<br>Lung (cells)<br>Brain | 30-9-1-G8-PU |
| ID340 | ext-est-not-vrt | 4.9 | Lung<br>Brain | 33-98-1-C6-PU |

TABLE II-continued

| SEQ. ID NO. | CATEGORY | VON HEIJNE SCORE | TISSUE SOURCE | INTERNAL DESIGNATION |
|---|---|---|---|---|
| ID341 | ext-est-not-vrt | 4.5 | Ovary<br>Prostate<br>Normal prostate<br>Brain | 78-26-1-B12-PU |
| ID342 | ext-est-not-vrt | 4.2 | Fetal kidney<br>Cancerous prostate<br>Normal prostate | 58-7-2-F8-PU |
| ID343 | ext-est-not-vrt | 3.7 | Fetal kidney<br>Ovary<br>Prostate<br>Normal prostate | 58-33-1-F9-PU |
| ID344 | ext-est-not-vrt | 3.6 | Brain<br>Lymph ganglia | 33-19-1-F1-PU |
| ID345 | ext-est-not-vrt | 3.5 | Fetal kidney<br>Liver<br>Kidney<br>Brain | 58-14-2-D3-PU |
| ID346 | ext-est-not-vrt | 3.5 | Ovary<br>Hypertrophic prostate | 26-40-2-B2-PU |
| ID347 | est-not-ext | 13.9 | Fetal kidney<br>Cancerous prostate<br>Normal prostate | 58-52-4-F10-PU |
| ID348 | est-not-ext | 13.9 | Fetal kidney<br>Lung (cells) | 58-15-1-H6-PU |
| ID349 | est-not-ext | 11.6 | Ovary<br>Dystrophic muscle<br>Cancerous prostate<br>Uterus<br>Testis<br>Lymph ganglia<br>Surrenals | 51-29-2-B2-PU |
| ID350 | est-not-ext | 11.6 | Lymph ganglia<br>Large intestine | 48-7-1-F2-PU |
| ID351 | est-not-ext | 11.6 | Umbilical cord<br>Pancreas | 37-6-1-E12-PU |
| ID352 | est-not-ext | 11.4 | Heart<br>Brain | 67-3-4-G7-PU |
| ID353 | est-not-ext | 11.2 | Dystrophic muscle<br>Brain | 33-35-4-F4-PU |
| ID354 | est-not-ext | 11 | Ovary<br>Heart<br>Kidney<br>Cancerous prostate<br>Lymph ganglia | 48-14-1-A11-PU |
| ID355 | est-not-ext | 10.5 | Lung<br>Umbilical cord<br>Normal prostate | 37-11-1-G2-PU |
| ID356 | est-not-ext | 10 | Fetal kidney<br>Cancerous prostate<br>Normal prostate<br>Brain | 58-3-4-G2-PU |
| ID357 | est-not-ext | 9.5 | Fetal kidney<br>Cancerous prostate<br>Umbilical cord<br>Normal prostate | 76-18-1-F6-PU |
| ID358 | est-not-ext | 9.5 | Placenta<br>Muscle<br>Substantia nigra | 47-24-2-C1-PU |
| ID359 | est-not-ext | 9.3 | Ovary<br>Cancerous prostate<br>Umbilical cord<br>Colon<br>Normal prostate<br>Testis | 37-11-4-H11-PU |
| ID360 | est-not-ext | 9.3 | Cancerous prostate<br>Normal prostate<br>Substantia nigra | 47-37-2-E3-PU |
| ID361 | est-not-ext | 9.3 | Spleen<br>Muscle | 27-16-1-E4-PU |
| ID362 | est-not-ext | 9.3 | Colon<br>Substantia nigra | 47-5-1-G3-PU |
| ID363 | est-not-ext | 9.2 | Ovary<br>Hypertrophic prostate<br>Fetal brain | 57-2-4-E11-PU |
| ID364 | est-not-ext | 9 | Cancerous prostate<br>Normal prostate | 76-32-1-G12-PU |

TABLE II-continued

| SEQ. ID NO. | CATEGORY | VON HEIJNE SCORE | TISSUE SOURCE | INTERNAL DESIGNATION |
|---|---|---|---|---|
| ID365 | est-not-ext | 8.9 | Fetal kidney<br>Hypertrophic prostate<br>Placenta<br>Normal prostate<br>Brain | 77-25-1-C6-PU |
| ID366 | est-not-ext | 8.8 | Dystrophic muscle<br>Umbilical cord<br>Brain | 37-7-2-B11-PU |
| ID367 | est-not-ext | 8.8 | Fetal kidney<br>Dystrophic muscle<br>Hypertrophic prostate<br>Thyroid<br>Cancerous prostate<br>Fetal brain<br>Muscle<br>Lung (cells)<br>Normal prostate<br>Brain<br>Lymph ganglia<br>Large intestine | 77-7-3-C8-PU |
| ID368 | est-not-ext | 8.7 | Fetal kidney<br>Prostate<br>Hypertrophic prostate<br>Spleen<br>Lung (cells)<br>Umbilical cord<br>Testis<br>Brain<br>Lymph ganglia | 48-7-3-G5-PU |
| ID369 | est-not-ext | 8.6 | Fetal kidney<br>Normal prostate | 78-17-2-E5-PU |
| ID370 | est-not-ext | 8.6 | Placenta<br>Brain | 33-10-4-E2-PU |
| ID371 | est-not-ext | 8.5 | Umbilical cord<br>Normal prostate | 37-11-1-C7-PU |
| ID372 | est-not-ext | 8.5 | Fetal kidney<br>Lymphocytes<br>Ovary<br>Hypertrophic prostate | 26-48-1-H10-PU |
| ID373 | est-not-ext | 8.3 | Prostate<br>Cancerous prostate<br>Spleen<br>Normal prostate<br>Brain<br>Lymph ganglia<br>Large intestine | 60-13-3-F6-PU |
| ID374 | est-not-ext | 8.3 | Cancerous prostate<br>Normal prostate | 78-22-4-A12-PU |
| ID375 | est-not-ext | 8.1 | Fetal kidney<br>Ovary<br>Dystrophic muscle<br>Hypertrophic prostate<br>Cancerous prostate<br>Lung<br>Spleen<br>Placenta<br>Fetal brain<br>Normal prostate<br>Colon<br>Brain<br>Substantia nigra | 57-28-4-B11-PU |
| ID376 | est-not-ext | 8 | Cancerous prostate<br>Uterus<br>Lung (cells)<br>Colon<br>Brain<br>Substantia nigra | 33-106-3-D8-PU |
| ID377 | est-not-ext | 7.9 | Normal prostate<br>Colon | 23-8-3-F5-PU |
| ID378 | est-not-ext | 7.8 | Placenta<br>Brain | 17-1-3-H5 |
| ID379 | est-not-ext | 7.6 | Lung<br>Normal prostate<br>Brain<br>Substantia nigra | 33-37-2-G9-PU |

TABLE II-continued

| SEQ. ID NO. | CATEGORY | VON HEIJNE SCORE | TISSUE SOURCE | INTERNAL DESIGNATION |
|---|---|---|---|---|
| ID380 | est-not-ext | 7.6 | Brain<br>Testis | 51-16-4-H4-PU |
| ID381 | est-not-ext | 7.6 | Hypertrophic prostate<br>Cancerous prostate<br>Fetal brain<br>Muscle<br>Brain<br>Lymph ganglia<br>Large intestine<br>Surrenals | 33-32-3-G1-PU |
| ID382 | est-not-ext | 7.6 | Fetal kidney<br>Hypertrophic prostate<br>Cancerous prostate<br>Lung (cells)<br>Umbilical cord<br>Normal prostate<br>Brain<br>Surrenals<br>Substantia nigra | 47-10-4-F3-PU |
| ID383 | est-not-ext | 7.4 | Heart<br>Cancerous prostate<br>Testis | 51-1-3-G10-PU |
| ID384 | est-not-ext | 7.4 | Umbilical cord<br>Brain<br>Lymph ganglia | 33-39-4-B2-PU |
| ID385 | est-not-ext | 7.4 | Normal prostate<br>Brain<br>Substantia nigra | 47-14-3-A3-PU |
| ID386 | est-not-ext | 7.4 | Liver<br>Lymph ganglia | 48-53-3-H11-PU |
| ID387 | est-not-ext | 7.4 | Cerebellum<br>Dystrophic muscle<br>Hypertrophic prostate<br>Heart<br>Uterus<br>Umbilical cord<br>Brain | 33-63-1-C3-PU |
| ID388 | est-not-ext | 7.3 | Fetal kidney<br>Ovary<br>Hypertrophic prostate<br>Spleen<br>Lung (cells)<br>Umbilical cord<br>Normal prostate<br>Brain<br>Substantia nigra | 53-3-4-F11-PU |
| ID389 | est-not-ext | 7.2 | Fetal kidney<br>Fetal brain<br>Uterus<br>Muscle<br>Umbilical cord<br>Lung (cells)<br>Colon<br>Normal prostate<br>Brain<br>Lymph ganglia<br>Fetal liver<br>Substantia nigra<br>Surrenals | 48-5-4-E8-PU |
| ID390 | est-not-ext | 7.1 | Cancerous prostate<br>Lymph ganglia<br>Large intestine<br>Surrenals | 48-54-3-D2-PU |
| ID391 | est-not-ext | 7.1 | Prostate<br>Hypertrophic prostate<br>Cancerous prostate<br>Normal prostate | 78-18-3-C8-PU |
| ID392 | est-not-ext | 7.1 | Normal prostate<br>Testis | 51-4-2-E10-PU |
| ID393 | est-not-ext | 7 | Fetal kidney<br>Lymphocytes<br>Umbilical cord | 24-11-1-E4-PU |
| ID394 | est-not-ext | 7 | Cancerous prostate<br>Brain | 76-1-2-B8-PU |

TABLE II-continued

| SEQ. ID NO. | CATEGORY | VON HEIJNE SCORE | TISSUE SOURCE | INTERNAL DESIGNATION |
|---|---|---|---|---|
| ID395 | est-not-ext | 6.7 | Ovary<br>Thyroid<br>Cancerous prostate<br>Uterus<br>Muscle<br>Normal prostate<br>Testis<br>Lymph ganglia | 51-11-3-G9-PU |
| ID396 | est-not-ext | 6.7 | Hypertrophic prostate<br>Lung<br>Brain<br>Surrenals | 77-16-4-G3-PU |
| ID397 | est-not-ext | 6.6 | Fetal kidney<br>Hypertrophic prostate | 77-38-2-D5-PU |
| ID398 | est-not-ext | 6.6 | Fetal kidney<br>Cancerous prostate<br>Brain | 58-3-3-C8-PU |
| ID399 | est-not-ext | 6.5 | Brain<br>Testis | 51-1-4-C1-PU |
| ID400 | est-not-ext | 6.5 | Fetal kidney<br>Brain<br>Lymph ganglia | 58-9-2-A6-PU |
| ID401 | est-not-ext | 6.3 | Fetal kidney<br>Cancerous prostate<br>Lung (cells) | 30-4-1-E7-PU |
| ID402 | est-not-ext | 6.3 | Normal prostate<br>Brain | 33-51-3-H4-PU |
| ID403 | est-not-ext | 6.3 | Cancerous prostate<br>Fetal brain | 57-27-3-A11-PU |
| ID404 | est-not-ext | 6.3 | Hypertrophic prostate<br>Fetal brain<br>Normal prostate<br>Brain | 57-5-4-G1-PU |
| ID405 | est-not-ext | 6.2 | Fetal kidney<br>Normal prostate<br>Testis | 58-6-1-H4-PU |
| ID406 | est-not-ext | 6.2 | Fetal kidney<br>Liver<br>Cancerous prostate<br>Umbilical cord | 37-12-1-D7-PU |
| ID407 | est-not-ext | 6.2 | Cancerous prostate<br>Normal prostate<br>Large intestine | 78-13-1-H1-PU |
| ID408 | est-not-ext | 6.2 | Brain<br>Substantia nigra | 33-18-3-G10-PU |
| ID409 | est-not-ext | 6.2 | Normal prostate<br>Substantia nigra | 78-39-4-B9-PU |
| ID410 | est-not-ext | 6.2 | Brain<br>Substantia nigra | 33-18-2-B1-PU |
| ID411 | est-not-ext | 6.1 | Fetal kidney<br>Umbilical cord<br>Normal prostate | 37-4-3-D5-PU |
| ID412 | est-not-ext | 6.1 | Cerebellum<br>Muscle<br>Brain<br>Substantia nigra<br>Fetal kidney<br>Prostate<br>Hypertrophic prostate<br>Cancerous prostate<br>Lung<br>Lung (cells)<br>Umbilical cord<br>Normal prostate<br>Testis<br>Lymph ganglia<br>Large intestine<br>Surrenals | 58-35-3-D12-PU |
| ID413 | est-not-ext | 6.1 | Fetal liver<br>Testis | 51-38-3-D10-PU |
| ID414 | est-not-ext | 6.1 | Uterus<br>Fetal liver<br>Substantia nigra<br>Ovary<br>Cancerous prostate<br>Fetal brain | 76-14-3-G2-PU |

TABLE II-continued

| SEQ. ID NO. | CATEGORY | VON HEIJNE SCORE | TISSUE SOURCE | INTERNAL DESIGNATION |
|---|---|---|---|---|
| | | | Normal prostate | |
| | | | Lymph ganglia | |
| ID415 | est-not-ext | 6.1 | Cancerous prostate | 76-30-1-F7-PU |
| | | | Normal prostate | |
| ID416 | est-not-ext | 6 | Brain | 76-43-3-E11-PU |
| | | | Cancerous prostate | |
| ID417 | est-not-ext | 6 | Thyroid | 78-41-2-H7-PU |
| | | | Pancreas | |
| | | | Fetal kidney | |
| | | | Normal prostate | |
| ID418 | est-not-ext | 5.9 | Liver | 59-8-1-B7-PU |
| | | | Lung | |
| ID419 | est-not-ext | 5.8 | Brain | 78-37-4-E6-PU |
| | | | Lung | |
| | | | Normal prostate | |
| ID420 | est-not-ext | 5.8 | Kidney | 59-1-2-E4-PU |
| | | | Cancerous prostate | |
| | | | Lung | |
| ID421 | est-not-ext | 5.7 | Umbilical cord | 78-38-4-G2-PU |
| | | | Normal prostate | |
| ID422 | est-not-ext | 5.7 | Lymphocytes | 20-1-3-G5-PU |
| | | | Spleen | |
| | | | Uterus | |
| | | | Substantia nigra | |
| | | | Fetal kidney | |
| | | | Hypertrophic prostate | |
| | | | Cancerous prostate | |
| | | | Normal prostate | |
| | | | Testis | |
| ID423 | est-not-ext | 5.7 | Brain | 58-37-3-E3-PU |
| | | | Fetal kidney | |
| ID424 | est-not-ext | 5.7 | Brain | 33-15-1-H3-PU |
| | | | Fetal brain | |
| ID425 | est-not-ext | 5.6 | Lymphocytes | 37-1-1-C2-PU |
| | | | Thyroid | |
| | | | Spleen | |
| | | | Uterus | |
| | | | Substantia nigra | |
| | | | Hypertrophic prostate | |
| | | | Umbilical cord | |
| | | | Normal prostate | |
| | | | Surrenals | |
| ID426 | est-not-ext | 5.6 | Fetal kidney | 48-10-1-A8-PU |
| | | | Umbilical cord | |
| | | | Lymph ganglia | |
| ID427 | est-not-ext | 5.6 | Surrenals | 62-1-2-D2-PU |
| ID428 | est-not-ext | 5.6 | Brain | 33-12-4-A7-PU |
| | | | Hypertrophic prostate | |
| ID429 | est-not-ext | 5.6 | Brain | 78-30-4-H3-PU |
| | | | Normal prostate | |
| ID430 | est-not-ext | 5.6 | Cerebellum | 47-8-4-C11-PU |
| | | | Brain | |
| | | | Substantia nigra | |
| | | | Fetal kidney | |
| | | | Hypertrophic prostate | |
| | | | Lung | |
| | | | Fetal brain | |
| | | | Normal prostate | |
| | | | Lymph ganglia | |
| ID431 | est-not-ext | 5.6 | Thyroid | 84-4-2-C1-PU |
| | | | Brain | |
| ID432 | est-not-ext | 5.6 | Brain | 30-12-4-C2-PU |
| | | | Dystrophic muscle | |
| | | | Lung (cells) | |
| | | | Normal prostate | |
| | | | Testis | |
| ID433 | est-not-ext | 5.6 | Placenta | 1-32-0-D10 |
| | | | Lung | |
| ID434 | est-not-ext | 5.5 | Ovary | 30-1-2-E3-PU |
| | | | Lung (cells) | |
| ID435 | est-not-ext | 5.5 | Ovary | 60-11-1-F1-PU |
| | | | Prostate | |
| | | | Lymph ganglia | |
| ID436 | est-not-ext | 5.5 | Spleen | 33-105-2-C3-PU |
| | | | Brain | |
| | | | Fetal kidney | |

TABLE II-continued

| SEQ. ID NO. | CATEGORY | VON HEIJNE SCORE | TISSUE SOURCE | INTERNAL DESIGNATION |
|---|---|---|---|---|
| | | | Prostate | |
| | | | Hypertrophic prostate | |
| | | | Lung (cells) | |
| | | | Umbilical cord | |
| | | | Testis | |
| | | | Lymph ganglia | |
| ID437 | est-not-ext | 5.5 | Cancerous prostate | 76-31-4-H1-PU |
| | | | Normal prostate | |
| ID438 | est-not-ext | 5.5 | Fetal kidney | 30-10-3-B10-PU |
| | | | Ovary | |
| | | | Cancerous prostate | |
| | | | Umbilical cord | |
| | | | Lung (cells) | |
| ID439 | est-not-ext | 5.4 | Muscle | 27-3-2-E11-PU |
| | | | Fetal kidney | |
| | | | Cancerous prostate | |
| | | | Lung | |
| | | | Lymph ganglia | |
| ID440 | est-not-ext | 5.3 | Placenta | 31-9-2-F9-PU |
| | | | Muscle | |
| | | | Brain | |
| | | | Substantia nigra | |
| | | | Cancerous prostate | |
| | | | Umbilical cord | |
| ID441 | est-not-ext | 5.3 | Brain | 47-40-3-D2-PU |
| | | | Substantia nigra | |
| | | | Fetal kidney | |
| ID442 | est-not-ext | 5.3 | Brain | 33-77-1-F10-PU |
| | | | Substantia nigra | |
| | | | Lung | |
| ID443 | est-not-ext | 5.2 | Cerebellum | 51-19-3-D6-PU |
| | | | Ovary | |
| | | | Umbilical cord | |
| | | | Testis | |
| ID444 | est-not-ext | 5.2 | Brain | 51-6-2-F10-PU |
| | | | Hypertrophic prostate | |
| | | | Colon | |
| | | | Testis | |
| ID445 | est-not-ext | 5.2 | Brain | 33-72-4-C5-PU |
| | | | Fetal kidney | |
| | | | Fetal brain | |
| | | | Umbilical cord | |
| | | | Normal prostate | |
| ID446 | est-not-ext | 5 | Brain | 33-18-3-E6-PU |
| | | | Normal prostate | |
| ID447 | est-not-ext | 5 | Brain | 33-5-2-E1-PU |
| | | | Substantia nigra | |
| | | | Fetal kidney | |
| | | | Umbilical cord | |
| | | | Lymph ganglia | |
| ID448 | est-not-ext | 5 | Liver | 76-22-3-E4-PU |
| | | | Uterus | |
| | | | Muscle | |
| | | | Heart | |
| | | | Cancerous prostate | |
| ID449 | est-not-ext | 5 | Fetal kidney | 51-15-2-H5-PU |
| | | | Testis | |
| ID450 | est-not-ext | 4.9 | Colon | 78-33-3-A9-PU |
| | | | Normal prostate | |
| ID451 | est-not-ext | 4.9 | Brain | 58-42-2-H11-PU |
| | | | Substantia nigra | |
| | | | Fetal kidney | |
| | | | Dystrophic muscle | |
| | | | Cancerous prostate | |
| | | | Lung | |
| | | | Lymph ganglia | |
| ID452 | est-not-ext | 4.9 | Brain | 33-111-3-F7-PU |
| | | | Substantia nigra | |
| ID453 | est-not-ext | 4.9 | Substantia nigra | 76-44-3-C5-PU |
| | | | Fetal kidney | |
| | | | Hypertrophic prostate | |
| | | | Cancerous prostate | |
| ID454 | est-not-ext | 4.9 | Substantia nigra | 78-40-4-B10-PU |
| | | | Normal prostate | |
| | | | Testis | |
| | | | Surrenals | |

TABLE II-continued

| SEQ. ID NO. | CATEGORY | VON HEIJNE SCORE | TISSUE SOURCE | INTERNAL DESIGNATION |
|---|---|---|---|---|
| ID455 | est-not-ext | 4.9 | Fetal kidney<br>Normal prostate | 78-6-3-F5-PU |
| ID456 | est-not-ext | 4.9 | Thyroid<br>Brain<br>Fetal kidney | 58-48-4-E2-PU |
| ID457 | est-not-ext | 4.8 | Placenta<br>Hypertrophic prostate<br>Normal prostate | 77-38-1-F10-PU |
| ID458 | est-not-ext | 4.8 | Lung (cells)<br>Normal prostate | 30-7-4-D6-PU |
| ID459 | est-not-ext | 4.8 | Cancerous prostate<br>Lymph ganglia | 48-4-2-H3-PU |
| ID460 | est-not-ext | 4.8 | Brain<br>Dystrophic muscle<br>Normal prostate | 33-77-4-E8-PU |
| ID461 | est-not-ext | 4.8 | Brain<br>Substantia nigra | 33-111-2-B4-PU |
| ID462 | est-not-ext | 4.7 | Normal prostate<br>Surrenals | 62-8-1-A5-PU |
| ID463 | est-not-ext | 4.7 | Brain<br>Fetal kidney | 33-6-1-G11-PU |
| ID464 | est-not-ext | 4.7 | Fetal liver<br>Substantia nigra<br>Fetal kidney<br>Heart<br>Cancerous prostate<br>Umbilical cord<br>Normal prostate | 58-13-1-H2-PU |
| ID465 | est-not-ext | 4.7 | Liver<br>Brain<br>Substantia nigra<br>Fetal kidney<br>Lung (cells)<br>Testis<br>Large intestine | 58-40-2-H6-PU |
| ID466 | est-not-ext | 4.7 | Brain<br>Fetal brain | 33-50-3-C3-PU |
| ID467 | est-not-ext | 4.7 | Thyroid<br>Spleen<br>Placenta<br>Muscle<br>Brain<br>Substantia nigra<br>Fetal kidney<br>Ovary<br>Heart<br>Cancerous prostate<br>Lung<br>Fetal brain<br>Umbilical cord<br>Normal prostate<br>Colon<br>Testis<br>Lymph ganglia<br>Surrenals | 62-10-4-C5-PU |
| ID468 | est-not-ext | 4.6 | Prostate<br>Lung (cells) | 60-16-2-F2-PU |
| ID469 | est-not-ext | 4.6 | Muscle<br>Brain<br>Substantia nigra<br>Fetal brain<br>Testis | 33-87-2-D2-PU |
| ID470 | est-not-ext | 4.6 | Liver<br>Brain | 33-80-3-B8-PU |
| ID471 | est-not-ext | 4.5 | Liver<br>Cancerous prostate<br>Normal prostate | 22-12-3-D4-PU |
| ID472 | est-not-ext | 4.5 | Lymphocytes<br>Spleen<br>Uterus<br>Placenta<br>Muscle<br>Brain<br>Substantia nigra<br>Fetal kidney<br>Ovary | 48-51-4-C11-PU |

TABLE II-continued

| SEQ. ID NO. | CATEGORY | VON HEIJNE SCORE | TISSUE SOURCE | INTERNAL DESIGNATION |
|---|---|---|---|---|
| | | | Prostate | |
| | | | Dystrophic muscle | |
| | | | Hypertrophic prostate | |
| | | | Heart | |
| | | | Cancerous prostate | |
| | | | Lung | |
| | | | Fetal brain | |
| | | | Lung (cells) | |
| | | | Umbilical cord | |
| | | | Normal prostate | |
| | | | Colon | |
| | | | Testis | |
| | | | Lymph ganglia | |
| | | | Surrenals | |
| ID473 | est-not-ext | 4.5 | Cerebellum | 47-15-1-H8-PU |
| | | | Substantia nigra | |
| | | | Normal prostate | |
| ID474 | est-not-ext | 4.4 | Hypertrophic prostate | 30-12-3-G5-PU |
| | | | Lung (cells) | |
| ID475 | est-not-ext | 4.4 | Brain | 58-4-4-D4-PU |
| | | | Fetal kidney | |
| | | | Cancerous prostate | |
| | | | Umbilical cord | |
| | | | Normal prostate | |
| ID476 | est-not-ext | 4.4 | Spleen | 53-3-2-D4-PU |
| ID477 | est-not-ext | 4.4 | Pancreas | 58-54-2-H8-PU |
| | | | Fetal kidney | |
| ID478 | est-not-ext | 4.4 | Thyroid | 27-17-2-C12-PU |
| | | | Kidney | |
| | | | Muscle | |
| | | | Brain | |
| | | | Ovary | |
| | | | Cancerous prostate | |
| | | | Umbilical cord | |
| | | | Normal prostate | |
| ID479 | est-not-ext | 4.4 | Liver | 48-5-3-A1-PU |
| | | | Placenta | |
| | | | Heart | |
| | | | Normal prostate | |
| | | | Lymph ganglia | |
| ID480 | est-not-ext | 4.4 | Placenta | 33-21-3-D12-PU |
| | | | Brain | |
| ID481 | est-not-ext | 4.4 | Substantia nigra | 47-2-3-B3-PU |
| | | | Fetal kidney | |
| | | | Umbilical cord | |
| ID482 | est-not-ext | 4.3 | Muscle | 58-15-2-D7-PU |
| | | | Fetal kidney | |
| | | | Cancerous prostate | |
| | | | Lung (cells) | |
| ID483 | est-not-ext | 4.3 | Substantia nigra | 58-41-1-G7-PU |
| | | | Fetal kidney | |
| | | | Fetal brain | |
| ID484 | est-not-ext | 4.2 | Brain | 77-5-3-F3-PU |
| | | | Fetal kidney | |
| | | | Hypertrophic prostate | |
| | | | Normal prostate | |
| ID485 | est-not-ext | 4.2 | Brain | 33-106-2-B3-PU |
| | | | Fetal kidney | |
| ID486 | est-not-ext | 4.2 | | 58-3-3-B2-PU |
| ID487 | est-not-ext | 4.2 | Normal prostate | 48-46-2-G12-PU |
| | | | Lymph ganglia | |
| ID488 | est-not-ext | 4.1 | Brain | 58-44-2-B3-PU |
| | | | Substantia nigra | |
| | | | Fetal kidney | |
| | | | Hypertrophic prostate | |
| | | | Lung (cells) | |
| | | | Testis | |
| ID489 | est-not-ext | 4.1 | Cerebellum | 47-18-4-E3-PU |
| | | | Substantia nigra | |
| ID490 | est-not-ext | 4.1 | Muscle | 78-21-3-F8-PU |
| | | | Substantia nigra | |
| | | | Normal prostate | |
| ID491 | est-not-ext | 4.1 | Brain | 33-49-1-H4-PU |
| | | | Surrenals | |
| ID492 | est-not-ext | 4.1 | Brain | 23-11-1-E11-PU |
| | | | Fetal kidney | |

TABLE II-continued

| SEQ. ID NO. | CATEGORY | VON HEIJNE SCORE | TISSUE SOURCE | INTERNAL DESIGNATION |
|---|---|---|---|---|
| ID493 | est-not-ext | 4 | Fetal brain<br>Normal prostate<br>Colon<br>Cerebellum<br>Brain<br>Heart | 33-5-2-H4-PU |
| ID494 | est-not-ext | 4 | Fetal brain<br>Normal prostate<br>Brain | 78-12-4-D9-PU |
| ID495 | est-not-ext | 4 | Normal prostate<br>Spleen | 33-103-1-D10-PU |
| ID496 | est-not-ext | 4 | Brain<br>Hypertrophic prostate<br>Normal prostate<br>Placenta | 33-100-4-B7-PU |
| ID497 | est-not-ext | 3.9 | Brain<br>Substantia nigra<br>Hypertrophic prostate<br>Dystrophic muscle<br>Umbilical cord | 29-11-2-D6-PU |
| ID498 | est-not-ext | 3.9 | Normal prostate | 78-27-3-D1-PU |
| ID499 | est-not-ext | 3.9 | Brain<br>Hypertrophic prostate<br>Cancerous prostate | 76-30-1-H7-PU |
| ID500 | est-not-ext | 3.9 | Uterus<br>Substantia nigra<br>Hypertrophic prostate | 74-10-3-C9-PU |
| ID501 | est-not-ext | 3.9 | Cancerous prostate | 76-19-1-A9-PU |
| ID502 | est-not-ext | 3.9 | Liver<br>Muscle<br>Brain<br>Cancerous prostate<br>Normal prostate | 76-44-4-A6-PU |
| ID503 | est-not-ext | 3.8 | Uterus<br>Brain<br>Substantia nigra | 74-2-1-H4-PU |
| ID504 | est-not-ext | 3.8 | Muscle<br>Lung (cells) | 27-21-1-H3-PU |
| ID505 | est-not-ext | 3.8 | Placenta<br>Brain | 33-13-3-E8-PU |
| ID506 | est-not-ext | 3.8 | Thyroid<br>Brain<br>Heart<br>Cancerous prostate<br>Fetal brain<br>Lung (cells)<br>Normal prostate<br>Testis<br>Lymph ganglia | 84-3-1-G10-PU |
| ID507 | est-not-ext | 3.7 | Uterus<br>Brain<br>Fetal kidney<br>Cancerous prostate | 33-8-1-A3-PU |
| ID508 | est-not-ext | 3.7 | Dystrophic muscle<br>Cancerous prostate | 76-43-4-H1-PU |
| ID509 | est-not-ext | 3.7 | Thyroid<br>Placenta | 84-5-4-H7-PU |
| ID510 | est-not-ext | 3.7 | Brain<br>Lung (cells)<br>Umbilical cord<br>Testis<br>Lymph ganglia | 37-4-1-B2-PU |
| ID511 | est-not-ext | 3.7 | Kidney<br>Placenta<br>Uterus<br>Hypertrophic prostate<br>Normal prostate<br>Lymph ganglia<br>Surrenals | 74-11-4-A9-PU |
| ID512 | est-not-ext | 3.7 | Substantia nigra<br>Hypertrophic prostate<br>Cancerous prostate | 77-2-2-B9-PU |
| ID513 | est-not-ext | 3.7 | Fetal kidney<br>Cancerous prostate<br>Lymph ganglia | 58-8-1-F2-PU |

TABLE II-continued

| SEQ. ID NO. | CATEGORY | VON HEIJNE SCORE | TISSUE SOURCE | INTERNAL DESIGNATION |
|---|---|---|---|---|
| ID514 | est-not-ext | 3.7 | Uterus<br>Prostate<br>Normal prostate<br>Lymph ganglia | 74-7-2-F2-PU |
| ID515 | est-not-ext | 3.6 | Fetal kidney<br>Umbilical cord<br>Testis<br>Large intestine | 37-2-1-H11-PU |
| ID516 | est-not-ext | 3.5 | Lymphocytes<br>Brain<br>Fetal kidney<br>Normal prostate | 58-6-1-F3-PU |
| ID517 | est-not-ext | 3.5 | Muscle<br>Brain<br>Hypertrophic prostate | 33-54-3-G1-PU |
| ID518 | est-not-ext | 3.5 | Fetal liver<br>Substantia nigra | 47-39-2-H6-PU |
| ID519 | est-not-ext | 3.5 | Brain<br>Cancerous prostate<br>Surrenals | 76-17-1-F5-PU |
| ID520 | est-not-ext | 3.5 | Placenta<br>Muscle<br>Heart<br>Cancerous prostate<br>Lung (cells)<br>Umbilical cord<br>Colon | 27-7-3-D1-PU |
| ID521 | est-not-ext | 3.5 | Liver<br>Uterus<br>Muscle<br>Brain<br>Ovary<br>Dystrophic muscle<br>Cancerous prostate<br>Normal prostate<br>Colon<br>Large intestine | 74-5-1-E4-PU |
| ID522 | est-not-ext | 3.5 | Brain<br>Cancerous prostate<br>Fetal brain<br>Umbilical cord<br>Surrenals | 57-20-1-F6-PU |
| ID523 | ext-vrt-not-genomic | 7.4 | Spleen<br>Hypertrophic prostate<br>Lymph ganglia | 48-25-3-A3-PU |
| ID524 | ext-vrt-not-genomic | 7 | Brain<br>Pancreas<br>Hypertrophic prostate<br>Normal prostate | 46-1-3-F4-PU |
| ID525 | new | 11.8 | Umbilical cord | 37-4-1-A12-PU |
| ID526 | new | 10 | Lymph ganglia | 48-50-1-G11-PU |
| ID527 | new | 10 | Lymph ganglia | 48-16-2-C11-PU |
| ID528 | new | 10 | Placenta | 14-8-1-C10-PU |
| ID529 | new | 9.9 | Lymph ganglia | 48-48-3-E11-PU |
| ID530 | new | 9.6 | Lymph ganglia | 48-26-2-B9-PU |
| ID531 | new | 9.2 | Lymph ganglia | 48-25-4-D9-PU |
| ID532 | new | 8.9 | Lymph ganglia | 48-67-2-F5-PU |
| ID533 | new | 8.9 | Lymph ganglia | 48-47-4-H7-PU |
| ID534 | new | 8.6 | Lymph ganglia | 48-52-1-E10-PU |
| ID535 | new | 8.5 | Placenta | 14-8-4-G8-PU |
| ID536 | new | 8.4 | Lymph ganglia | 48-4-2-G5-PU |
| ID537 | new | 8.2 | Lymph ganglia | 48-27-2-D7-PU |
| ID538 | new | 7 | Lymph ganglia | 48-61-3-F5-PU |
| ID539 | new | 6.9 | Placenta | 14-7-4-G8 |
| ID540 | new | 6.9 | Lymph ganglia | 48-5-4-B6-PU |
| ID541 | new | 6.8 | Lymph ganglia | 48-46-3-C8-PU |
| ID542 | new | 6.7 | Lymph ganglia | 48-20-3-A6-PU |
| ID543 | new | 6.6 | Lymph ganglia | 48-18-2-F6-PU |
| ID544 | new | 6.5 | Lymph ganglia | 48-2-2-A10-PU |
| ID545 | new | 6.5 | Lymph ganglia | 48-25-4-C11-PU |
| ID546 | new | 6.3 | Lymph ganglia | 48-26-1-C4-PU |
| ID547 | new | 6.3 | Lymph ganglia | 48-31-2-G8-PU |
| ID548 | new | 6.3 | Lymph ganglia | 48-24-1-D8-PU |
| ID549 | new | 6.3 | Umbilical cord | 37-11-2-D10-PU |
| ID550 | new | 6.3 | Lymph ganglia | 48-8-2-C2-PU |
| ID551 | new | 6.2 | Lymph ganglia | 48-20-4-A8-PU |

TABLE II-continued

| SEQ. ID NO. | CATEGORY | VON HEIJNE SCORE | TISSUE SOURCE | INTERNAL DESIGNATION |
|---|---|---|---|---|
| ID552 | new | 6.1 | Lymph ganglia | 48-2-1-B9-PU |
| ID553 | new | 6.1 | Lymph ganglia | 48-54-1-G9-PU |
| ID554 | new | 6.1 | Lymph ganglia | 48-47-4-B7-PU |
| ID555 | new | 6.1 | Lymph ganglia | 48-8-1-D8-PU |
| ID556 | new | 5.9 | Lymph ganglia | 48-12-3-G8-PU |
| ID557 | new | 5.9 | Umbilical cord | 37-39-4-A5-PU |
| ID558 | new | 5.9 | Lymph ganglia | 48-25-1-B6-PU |
| ID559 | new | 5.7 | Lymph ganglia | 48-15-1-D2-PU |
| ID560 | new | 5.5 | Umbilical cord | 37-3-4-D1-PU |
| ID561 | new | 5.4 | Lymph ganglia | 48-13-1-G4-PU |
| ID562 | new | 5.4 | Lymph ganglia | 48-10-1-E4-PU |
| ID563 | new | 5.2 | Lymph ganglia | 48-8-1-A3-PU |
| ID564 | new | 5.2 | Umbilical cord | 37-7-4-F2-PU |
| ID565 | new | 5.2 | Lymph ganglia | 48-50-3-F1-PU |
| ID566 | new | 5.2 | Lymph ganglia | 48-8-2-B5-PU |
| ID567 | new | 5 | Placenta | 11-4-0-B11-RP |
| ID568 | new | 5 | Lymph ganglia | 48-48-4-H11-PU |
| ID569 | new | 4.9 | Umbilical cord | 37-2-1-B4-PU |
| ID570 | new | 4.8 | Lymph ganglia | 48-47-2-B2-PU |
| ID571 | new | 4.8 | Lymph ganglia | 48-3-4-C11-PU |
| ID572 | new | 4.8 | Lymphocytes | 24-6-1-C8-PU |
| ID573 | new | 4.8 | Placenta | 31-10-3-D2-PU |
| ID574 | new | 4.7 | Lymph ganglia | 48-54-3-F9-PU |
| ID575 | new | 4.7 | Lymph ganglia | 48-47-1-C9-PU |
| ID576 | new | 4.7 | Lymph ganglia | 48-4-2-C9-PU |
| ID577 | new | 4.6 | Umbilical cord | 37-33-2-E2-PU |
| ID578 | new | 4.5 | Umbilical cord | 37-2-1-B7-PU |
| ID579 | new | 4.5 | Lymph ganglia | 48-51-2-C3-PU |
| ID580 | new | 4.5 | Lymph ganglia | 48-23-4-D4-PU |
| ID581 | new | 4.4 | Umbilical cord | 37-4-1-A6-PU |
| ID582 | new | 4.4 | Lymph ganglia | 48-11-4-C10-PU |
| ID583 | new | 4.4 | Umbilical cord | 37-1-4-F3-PU |
| ID584 | new | 4.3 | Lymphocytes | 24-2-2-G10-PU |
| ID585 | new | 4.3 | Lymph ganglia | 48-26-3-G3-PU |
| ID586 | new | 4.1 | Lymph ganglia | 48-20-3-H2-PU |
| ID587 | new | 4.1 | Lymph ganglia | 48-31-3-F7-PU |
| ID588 | new | 4.1 | Lymph ganglia | 48-29-1-H9-PU |
| ID589 | new | 4.1 | Umbilical cord | 37-1-3-G4-PU |
| ID590 | new | 4.1 | Umbilical cord | 37-8-3-G12-PU |
| ID591 | new | 4.1 | Lymph ganglia | 48-26-4-G1-PU |
| ID592 | new | 4 | Lymph ganglia | 48-27-1-B12-PU |
| ID593 | new | 4 | Lymph ganglia | 48-22-1-H7-PU |
| ID594 | new | 4 | Lymphocytes | 24-1-4-F9-PU |
| ID595 | new | 4 | Lymph ganglia | 48-6-2-A1-PU |
| ID596 | new | 4 | Umbilical cord | 37-3-3-B3-PU |
| ID597 | new | 3.8 | Umbilical cord | 37-7-2-F6-PU |
| ID598 | new | 3.8 | Lymph ganglia | 48-52-1-A6-PU |
| ID599 | new | 3.8 | Lymph ganglia | 48-7-2-F5-PU |
| ID600 | new | 3.8 | Umbilical cord | 37-12-2-D12-PU |
| ID601 | new | 3.8 | Umbilical cord | 37-11-3-D2-PU |
| ID602 | new | 3.8 | Lymph ganglia | 48-1-1-H7-PU |
| ID603 | new | 3.7 | Lymph ganglia | 48-21-3-E1-PU |
| ID604 | new | 3.6 | Lymph ganglia | 48-26-3-B8-PU |
| ID605 | new | 3.6 | Umbilical cord | 37-9-2-D9-PU |
| ID606 | new | 3.6 | Lymph ganglia | 48-3-3-A3-PU |
| ID607 | new | 3.6 | Lymphocytes | 24-1-3-G11-PU |
| ID608 | new | 3.6 | Lymphocytes | 24-4-1-A4-PU |
| ID609 | new | 3.5 | Lymph ganglia | 48-23-2-B12-PU |
| ID610 | new | 3.5 | Lymph ganglia | 48-47-3-F2-PU |
| ID611 | new | 3.5 | Lymphocytes | 24-4-4-H11-PU |
| ID612 | new | 3.5 | Lymph ganglia | 48-7-3-B8-PU |
| ID613 | ext-est-not-vrt | 12.8 | Lymph ganglia | 48-12-4-E3-PU |
| ID614 | ext-est-not-vrt | 9.3 | Umbilical cord | 37-12-3-G9-PU |
| ID615 | ext-est-not-vrt | 9.3 | Lymph ganglia | 48-67-4-A6-PU |
| ID616 | ext-est-not-vrt | 8.1 | Lymph ganglia | 48-28-3-A9-PU |
| ID617 | ext-est-not-vrt | 7.7 | Lymphocytes | 24-3-3-C6-PU |
| ID618 | ext-est-not-vrt | 6.6 | Lymph ganglia | 48-28-4-C2-PU |
| ID619 | ext-est-not-vrt | 6.2 | Lymph ganglia | 48-25-2-A1-PU |
| ID620 | ext-est-not-vrt | 5.8 | Lymph ganglia | 48-24-4-B7-PU |
| ID621 | ext-est-not-vrt | 5.3 | Lymph ganglia | 48-6-1-C9-PU |
| ID622 | ext-est-not-vrt | 5.1 | Lymph ganglia | 48-7-4-H2-PU |
| ID623 | ext-est-not-vrt | 4.6 | Lymph ganglia | 48-28-3-B6-PU |
| ID624 | ext-est-not-vrt | 4.4 | Lymph ganglia | 48-3-1-H9-PU |
| ID625 | ext-est-not-vrt | 4.4 | Umbilical cord | 37-6-4-B11-PU |
| ID626 | ext-est-not-vrt | 3.9 | Lymph ganglia | 48-26-1-G10-PU |
| ID627 | ext-est-not-vrt | 3.8 | Umbilical cord | 37-9-4-H9-PU |

TABLE II-continued

| SEQ. ID NO. | CATEGORY | VON HEIJNE SCORE | TISSUE SOURCE | INTERNAL DESIGNATION |
|---|---|---|---|---|
| ID628 | ext-est-not-vrt | 3.7 | Lymphocytes | 24-1-4-F8-PU |
| ID629 | ext-est-not-vrt | 3.5 | Lymph ganglia | 48-21-3-H7-PU |
| ID630 | est-not-ext | 11.7 | Lymph ganglia | 48-6-4-G3-PU |
| ID631 | est-not-ext | 10.9 | Umbilical cord | 37-5-1-A12-PU |
| ID632 | est-not-ext | 10.9 | Lymph ganglia | 48-22-4-A8-PU |
| ID633 | est-not-ext | 9.6 | Lymph ganglia | 48-27-1-B8-PU |
| ID634 | est-not-ext | 9.6 | Umbilical cord | 37-4-1-G3-PU |
| ID635 | est-not-ext | 9.3 | Lymph ganglia | 48-11-4-E3-PU |
| ID636 | est-not-ext | 8.2 | Lymph ganglia | 48-25-4-D8-PU |
| ID637 | est-not-ext | 8.2 | Lymph ganglia | 48-19-3-G1-PU |
| ID638 | est-not-ext | 8.1 | Placenta | 31-11-4-B2-PU |
| ID639 | est-not-ext | 7.9 | Lymph ganglia | 48-7-4-H10-PU |
| ID640 | est-not-ext | 7.7 | Lymph ganglia | 48-11-4-F7-PU |
| ID641 | est-not-ext | 7.2 | Lymph ganglia | 48-10-3-B5-PU |
| ID642 | est-not-ext | 6.9 | Umbilical cord | 37-8-4-D3-PU |
| ID643 | est-not-ext | 6.4 | Umbilical cord | 37-6-2-D10-PU |
| ID644 | est-not-ext | 6.3 | Lymph ganglia | 48-17-1-D11-PU |
| ID645 | est-not-ext | 6.1 | Lymphocytes | 24-8-3-G1-PU |
| ID646 | est-not-ext | 6.1 | Umbilical cord | 37-12-2-D1-PU |
| ID647 | est-not-ext | 6.1 | Umbilical cord | 37-6-2-A10-PU |
| ID648 | est-not-ext | 6 | Lymph ganglia | 48-26-1-A11-PU |
| ID649 | est-not-ext | 5.9 | Lymph ganglia | 48-60-4-H5-PU |
| ID650 | est-not-ext | 5.8 | Umbilical cord | 37-29-2-G3-PU |
| ID651 | est-not-ext | 5.7 | Umbilical cord | 37-28-2-D3-PU |
| ID652 | est-not-ext | 5.6 | Lymph ganglia | 48-49-1-F5-PU |
| ID653 | est-not-ext | 5.5 | Umbilical cord | 37-2-2-D12-PU |
| ID654 | est-not-ext | 5.5 | Umbilical cord | 37-7-4-B3-PU |
| ID655 | est-not-ext | 5.3 | Lymph ganglia | 48-24-1-D2-PU |
| ID656 | est-not-ext | 5 | Lymph ganglia | 48-21-4-H4-PU |
| ID657 | est-not-ext | 4.9 | Umbilical cord | 37-41-4-B9-PU |
| ID658 | est-not-ext | 4.9 | Lymph ganglia | 48-12-3-E2-PU |
| ID659 | est-not-ext | 4.6 | Lymph ganglia | 48-5-4-C5-PU |
| ID660 | est-not-ext | 4.3 | Lymphocytes | 24-5-1-E2-PU |
| ID661 | est-not-ext | 4.1 | Lymph ganglia | 48-18-3-F9-PU |
| ID662 | est-not-ext | 4.1 | Lymphocytes | 24-5-1-H2-PU |
| ID663 | est-not-ext | 3.8 | Lymph ganglia | 48-6-2-G1-PU |
| ID664 | est-not-ext | 3.8 | Umbilical cord | 37-9-2-G10-PU |
| ID665 | est-not-ext | 3.7 | Lymph ganglia | 48-19-3-A7-PU |
| ID666 | est-not-ext | 3.5 | Lymph ganglia | 48-13-3-E3-PU |
| ID667 | est-not-ext | 3.5 | Lymph ganglia | 48-20-4-G6-PU |
| ID668 | est-not-ext | 3.5 | Lymphocytes | 24-4-1-G11-PU |
| ID669 | est-not-ext | 3.5 | Lymph ganglia | 48-4-2-E4-PU |
| ID670 | ext-vrt-not-genomic | 8.4 | Lymph ganglia | 48-24-1-B3-PU |
| ID671 | ext-vrt-not-genomic | 7.4 | Lymph ganglia | 48-30-2-B2-PU |
| ID672 | ext-vrt-not-genomic | 6.5 | Umbilical cord | 37-30-2-B3-PU |
| ID673 | new | 11.4 | Cancerous prostate | 76-36-2-G4-PU |
| ID674 | new | 11.3 | Normal prostate | 78-26-1-A7-PU |
| ID675 | new | 11 | Normal prostate | 78-4-3-G8-PU |
| ID676 | new | 10.7 | Hypertrophic prostate | 77-16-3-D7-PU |
| ID677 | new | 10.7 | Hypertrophic prostate | 77-7-1-H9-PU |
| ID678 | new | 10.6 | Hypertrophic prostate | 77-42-1-D10-PU |
| ID679 | new | 10.6 | Cancerous prostate | 76-34-4-C6-PU |
| ID680 | new | 10.4 | Normal prostate | 78-31-3-B8-PU |
| ID681 | new | 10.2 | Normal prostate | 78-38-1-C10-PU |
| ID682 | new | 10.2 | Cancerous prostate | 76-16-4-D5-PU |
| ID683 | new | 9 | Hypertrophic prostate | 77-38-2-B9-PU |
| ID684 | new | 8.8 | Normal prostate | 78-30-1-G12-PU |
| ID685 | new | 8.6 | Prostate | 60-17-1-F1-PU |
| ID686 | new | 8.5 | Prostate | 60-17-3-G8-PU |
| ID687 | new | 8.3 | Normal prostate | 78-8-2-H8-PU |
| ID688 | new | 8.3 | Normal prostate | 78-26-2-A1-PU |
| ID689 | new | 8.3 | Cancerous prostate | 76-23-2-B10-PU |
| ID690 | new | 8.2 | Cancerous prostate | 76-23-4-H9-PU |
| ID691 | new | 8.1 | Normal prostate | 78-44-2-C3-PU |
| ID692 | new | 8 | Hypertrophic prostate | 77-37-1-H3-PU |
| ID693 | new | 8 | Normal prostate | 78-35-2-G12-PU |
| ID694 | new | 7.8 | Normal prostate | 78-17-4-G2-PU |
| ID695 | new | 7.7 | Normal prostate | 78-5-4-F7-PU |
| ID696 | new | 7.6 | Normal prostate | 78-16-3-E2-PU |
| ID697 | new | 7.6 | Hypertrophic prostate | 77-5-1-B6-PU |
| ID698 | new | 7.6 | Normal prostate | 78-26-1-B5-PU |
| ID699 | new | 7.5 | Cancerous prostate | 76-12-1-B1-PU |
| ID700 | new | 7.5 | Normal prostate | 78-4-4-E7-PU |
| ID701 | new | 7.2 | Hypertrophic prostate | 77-11-1-A3-PU |
| ID702 | new | 7.2 | Hypertrophic prostate | 77-5-4-G9-PU |
| ID703 | new | 7.2 | Normal prostate | 78-23-4-H11-PU |

TABLE II-continued

| SEQ. ID NO. | CATEGORY | VON HEIJNE SCORE | TISSUE SOURCE | INTERNAL DESIGNATION |
|---|---|---|---|---|
| ID704 | new | 7.2 | Hypertrophic prostate | 77-39-3-H7-PU |
| ID705 | new | 7.2 | Cancerous prostate | 76-23-4-H2-PU |
| ID706 | new | 7.2 | Cancerous prostate | 76-24-1-F8-PU |
| ID707 | new | 7 | Normal prostate | 78-39-4-D2-PU |
| ID708 | new | 7 | Normal prostate | 78-28-3-D2-PU |
| ID709 | new | 7 | Normal prostate | 78-29-3-H11-PU |
| ID710 | new | 7 | Normal prostate | 78-40-3-G2-PU |
| ID711 | new | 7 | Cancerous prostate | 76-1-2-F8-PU |
| ID712 | new | 7 | Normal prostate | 78-13-4-B10-PU |
| ID713 | new | 6.9 | Cancerous prostate | 76-12-1-A9-PU |
| ID714 | new | 6.9 | Normal prostate | 78-20-3-C11-PU |
| ID715 | new | 6.9 | Cancerous prostate | 76-9-2-D10-PU |
| ID716 | new | 6.8 | Normal prostate | 78-6-2-D12-PU |
| ID717 | new | 6.7 | Hypertrophic prostate | 77-10-1-C8-PU |
| ID718 | new | 6.7 | Cancerous prostate | 76-13-2-F11-PU |
| ID719 | new | 6.7 | Cancerous prostate | 76-4-1-G5-PU |
| ID720 | new | 6.5 | Normal prostate | 78-3-4-B8-PU |
| ID721 | new | 6.4 | Prostate | 60-11-3-G2-PU |
| ID722 | new | 6.3 | Normal prostate | 78-25-1-G5-PU |
| ID723 | new | 6.3 | Normal prostate | 78-2-2-G5-PU |
| ID724 | new | 6.3 | Cancerous prostate | 76-7-3-A1-PU |
| ID725 | new | 6.3 | Hypertrophic prostate | 77-5-1-C2-PU |
| ID726 | new | 6.2 | Normal prostate | 78-49-2-A11-PU |
| ID727 | new | 6.1 | Normal prostate | 78-7-1-B9-PU |
| ID728 | new | 6 | Normal prostate | 78-39-4-G3-PU |
| ID729 | new | 6 | Normal prostate | 78-32-2-H6-PU |
| ID730 | new | 5.9 | Cancerous prostate | 76-30-3-H2-PU |
| ID731 | new | 5.9 | Normal prostate | 78-24-3-H4-PU |
| ID732 | new | 5.9 | Cancerous prostate | 76-43-3-B6-PU |
| ID733 | new | 5.8 | Prostate | 60-16-3-A3-PU |
| ID734 | new | 5.8 | Cancerous prostate | 76-20-4-C11-PU |
| ID735 | new | 5.7 | Cancerous prostate | 76-11-1-C5-PU |
| ID736 | new | 5.7 | Hypertrophic prostate | 77-37-3-C1-PU |
| ID737 | new | 5.7 | Prostate | 60-13-2-B5-PU |
| ID738 | new | 5.7 | Normal prostate | 78-49-4-E4-PU |
| ID739 | new | 5.6 | Normal prostate | 78-37-4-C11-PU |
| ID740 | new | 5.6 | Prostate | 60-17-1-D8-PU |
| ID741 | new | 5.5 | Normal prostate | 78-36-3-D7-PU |
| ID742 | new | 5.5 | Cancerous prostate | 76-24-3-E11-PU |
| ID743 | new | 5.5 | Prostate | 60-14-2-A7-PU |
| ID744 | new | 5.4 | Hypertrophic prostate | 77-10-4-F9-PU |
| ID745 | new | 5.3 | Cancerous prostate | 76-23-3-G5-PU |
| ID746 | new | 5.3 | Normal prostate | 78-42-3-D3-PU |
| ID747 | new | 5.3 | Prostate | 60-12-1-H1-PU |
| ID748 | new | 5.3 | Hypertrophic prostate | 77-5-2-A3-PU |
| ID749 | new | 5.2 | Normal prostate | 78-37-2-G12-PU |
| ID750 | new | 5.2 | Cancerous prostate | 76-39-2-H1-PU |
| ID751 | new | 5.1 | Prostate | 60-12-3-C2-PU |
| ID752 | new | 5.1 | Normal prostate | 78-25-1-F11-PU |
| ID753 | new | 5.1 | Normal prostate | 78-36-2-C10-PU |
| ID754 | new | 5.1 | Hypertrophic prostate | 77-13-1-B7-PU |
| ID755 | new | 5.1 | Hypertrophic prostate | 77-4-4-H7-PU |
| ID756 | new | 5 | Normal prostate | 78-33-4-F9-PU |
| ID757 | new | 5 | Cancerous prostate | 76-21-1-D5-PU |
| ID758 | new | 4.8 | Normal prostate | 78-3-4-B3-PU |
| ID759 | new | 4.8 | Cancerous prostate | 76-29-4-B3-PU |
| ID760 | new | 4.8 | Normal prostate | 78-46-3-C6-PU |
| ID761 | new | 4.8 | Hypertrophic prostate | 77-13-3-F8-PU |
| ID762 | new | 4.7 | Cancerous prostate | 76-12-4-C3-PU |
| ID763 | new | 4.7 | Cancerous prostate | 76-34-4-C1-PU |
| ID764 | new | 4.7 | Normal prostate | 78-42-4-D2-PU |
| ID765 | new | 4.7 | Cancerous prostate | 76-38-2-H9-PU |
| ID766 | new | 4.6 | Normal prostate | 78-49-4-B5-PU |
| ID767 | new | 4.6 | Cancerous prostate | 76-1-1-E3-PU |
| ID768 | new | 4.6 | Normal prostate | 78-46-3-C4-PU |
| ID769 | new | 4.5 | Cancerous prostate | 76-22-2-D2-PU |
| ID770 | new | 4.5 | Prostate | 60-11-4-F6-PU |
| ID771 | new | 4.5 | Normal prostate | 78-32-2-G1-PU |
| ID772 | new | 4.4 | Prostate | 60-14-3-C7-PU |
| ID773 | new | 4.4 | Hypertrophic prostate | 77-3-4-H3-PU |
| ID774 | new | 4.4 | Normal prostate | 78-36-4-E12-PU |
| ID775 | new | 4.3 | Hypertrophic prostate | 77-42-1-A9-PU |
| ID776 | new | 4.3 | Normal prostate | 78-23-2-H3-PU |
| ID777 | new | 4.2 | Cancerous prostate | 76-39-3-C11-PU |
| ID778 | new | 4.2 | Normal prostate | 78-23-3-D10-PU |
| ID779 | new | 4.2 | Cancerous prostate | 76-32-2-B7-PU |

TABLE II-continued

| SEQ. ID NO. | CATEGORY | VON HEIJNE SCORE | TISSUE SOURCE | INTERNAL DESIGNATION |
|---|---|---|---|---|
| ID780 | new | 4.2 | Normal prostate | 78-40-1-G9-PU |
| ID781 | new | 4.2 | Prostate | 60-12-1-E11-PU |
| ID782 | new | 4.1 | Cancerous prostate | 76-27-3-A6-PU |
| ID783 | new | 4 | Cancerous prostate | 76-43-3-B2-PU |
| ID784 | new | 4 | Normal prostate | 78-18-3-B4-PU |
| ID785 | new | 4 | Normal prostate | 78-41-2-D11-PU |
| ID786 | new | 4 | Normal prostate | 78-34-2-G9-PU |
| ID787 | new | 4 | Normal prostate | 78-4-3-G2-PU |
| ID788 | new | 4 | Hypertrophic prostate | 77-22-2-G2-PU |
| ID789 | new | 3.9 | Cancerous prostate | 76-4-4-F6-PU |
| ID790 | new | 3.9 | Hypertrophic prostate | 77-40-3-E10-PU |
| ID791 | new | 3.9 | Normal prostate | 78-10-1-H5-PU |
| ID792 | new | 3.9 | Normal prostate | 78-6-2-E3-PU |
| ID793 | new | 3.9 | Hypertrophic prostate | 77-20-3-E5-PU |
| ID794 | new | 3.9 | Normal prostate | 78-38-2-B5-PU |
| ID795 | new | 3.8 | Prostate | 60-11-2-G12-PU |
| ID796 | new | 3.8 | Cancerous prostate | 76-44-3-E8-PU |
| ID797 | new | 3.8 | Normal prostate | 78-41-3-A2-PU |
| ID798 | new | 3.7 | Cancerous prostate | 76-20-4-E7-PU |
| ID799 | new | 3.7 | Cancerous prostate | 76-17-1-E4-PU |
| ID800 | new | 3.7 | Normal prostate | 78-5-2-D2-PU |
| ID801 | new | 3.7 | Prostate | 60-11-3-B11-PU |
| ID802 | new | 3.7 | Hypertrophic prostate | 77-21-2-F1-PU |
| ID803 | new | 3.6 | Prostate | 60-12-1-A5-PU |
| ID804 | new | 3.6 | Cancerous prostate | 76-18-2-G12-PU |
| ID805 | new | 3.6 | Normal prostate | 78-7-1-G5-PU |
| ID806 | new | 3.6 | Cancerous prostate | 76-37-4-A5-PU |
| ID807 | new | 3.5 | Normal prostate | 78-50-4-A2-PU |
| ID808 | new | 3.5 | Normal prostate | 78-43-2-H10-PU |
| ID809 | new | 3.5 | Normal prostate | 78-44-3-B6-PU |
| ID810 | new | 3.5 | Cancerous prostate | 76-10-1-D6-PU |
| ID811 | new | 3.5 | Prostate | 60-11-4-F2-PU |
| ID812 | new | 3.5 | Cancerous prostate | 76-45-2-B12-PU |
| ID813 | ext-est-not-vrt | 14.8 | Normal prostate | 78-34-3-D9-PU |
| ID814 | ext-est-not-vrt | 13.6 | Normal prostate | 78-46-4-F4-PU |
| ID815 | ext-est-not-vrt | 12.7 | Normal prostate | 78-8-3-D9-PU |
| ID816 | ext-est-not-vrt | 8.8 | Prostate | 60-15-4-F6-PU |
| ID817 | ext-est-not-vrt | 8.5 | Normal prostate | 78-8-3-E6-PU |
| ID818 | ext-est-not-vrt | 7.3 | Normal prostate | 78-7-3-A4-PU |
| ID819 | ext-est-not-vrt | 7.1 | Cancerous prostate | 76-33-2-F5-PU |
| ID820 | ext-est-not-vrt | 6.6 | Cancerous prostate | 76-34-4-G12-PU |
| ID821 | ext-est-not-vrt | 6.3 | Normal prostate | 78-13-1-H7-PU |
| ID822 | ext-est-not-vrt | 5.9 | Normal prostate | 78-49-3-B11-PU |
| ID823 | ext-est-not-vrt | 5.9 | Normal prostate | 78-42-2-A10-PU |
| ID824 | ext-est-not-vrt | 5.5 | Cancerous prostate | 76-7-4-D9-PU |
| ID825 | ext-est-not-vrt | 5.2 | Normal prostate | 78-40-3-B12-PU |
| ID826 | ext-est-not-vrt | 5 | Hypertrophic prostate | 77-36-1-G2-PU |
| ID827 | ext-est-not-vrt | 4.8 | Prostate | 60-17-3-H11-PU |
| ID828 | ext-est-not-vrt | 4.4 | Normal prostate | 78-28-3-E4-PU |
| ID829 | ext-est-not-vrt | 4.1 | Cancerous prostate | 76-28-2-H5-PU |
| ID830 | ext-est-not-vrt | 4.1 | Normal prostate | 78-27-1-D11-PU |
| ID831 | ext-est-not-vrt | 3.9 | Cancerous prostate | 76-42-2-B5-PU |
| ID832 | ext-est-not-vrt | 3.9 | Hypertrophic prostate | 77-39-3-F8-PU |
| ID833 | ext-est-not-vrt | 3.7 | Cancerous prostate | 76-43-1-G9-PU |
| ID834 | est-not-ext | 13.8 | Normal prostate | 78-40-1-B10-PU |
| ID835 | est-not-ext | 13.4 | Cancerous prostate | 76-15-1-F4-PU |
| ID836 | est-not-ext | 13 | Cancerous prostate | 76-45-4-E7-PU |
| ID837 | est-not-ext | 11.6 | Normal prostate | 78-26-2-H7-PU |
| ID838 | est-not-ext | 11.2 | Normal prostate | 78-21-1-B7-PU |
| ID839 | est-not-ext | 11.2 | Cancerous prostate | 76-40-2-F5-PU |
| ID840 | est-not-ext | 10.6 | Cancerous prostate | 76-29-2-G8-PU |
| ID841 | est-not-ext | 10.5 | Hypertrophic prostate | 77-23-4-H11-PU |
| ID842 | est-not-ext | 20.3 | Normal prostate | 78-48-1-F10-PU |
| ID843 | est-not-ext | 9.5 | Cancerous prostate | 76-41-4-G9-PU |
| ID844 | est-not-ext | 9.3 | Hypertrophic prostate | 77-3-3-C10-PU |
| ID845 | est-not-ext | 9.1 | Cancerous prostate | 76-45-4-C8-PU |
| ID846 | est-not-ext | 8.8 | Normal prostate | 78-50-4-C10-PU |
| ID847 | est-not-ext | 8.8 | Normal prostate | 78-38-4-F7-PU |
| ID848 | est-not-ext | 8.6 | Cancerous prostate | 76-16-4-C9-PU |
| ID849 | est-not-ext | 8.6 | Normal prostate | 78-49-2-D10-PU |
| ID850 | est-not-ext | 8.4 | Cancerous prostate | 76-1-1-H7-PU |
| ID851 | est-not-ext | 7.9 | Normal prostate | 78-4-2-F10-PU |
| ID852 | est-not-ext | 7.9 | Normal prostate | 78-46-3-B6-PU |
| ID853 | est-not-ext | 7.7 | Normal prostate | 78-7-1-F2-PU |
| ID854 | est-not-ext | 7.6 | Normal prostate | 78-35-2-D3-PU |
| ID855 | est-not-ext | 7.6 | Cancerous prostate | 76-20-2-G7-PU |

TABLE II-continued

| SEQ. ID NO. | CATEGORY | VON HEIJNE SCORE | TISSUE SOURCE | INTERNAL DESIGNATION |
|---|---|---|---|---|
| ID856 | est-not-ext | 7.6 | Normal prostate | 78-39-1-E11-PU |
| ID857 | est-not-ext | 7.5 | Cancerous prostate | 76-4-4-C2-PU |
| ID858 | est-not-ext | 7.1 | Normal prostate | 78-48-2-F6-PU |
| ID859 | est-not-ext | 7 | Cancerous prostate | 76-32-4-A10-PU |
| ID860 | est-not-ext | 6.8 | Cancerous prostate | 76-39-1-E7-PU |
| ID861 | est-not-ext | 6.7 | Cancerous prostate | 76-29-4-E1-PU |
| ID862 | est-not-ext | 6.7 | Normal prostate | 78-28-4-B9-PU |
| ID863 | est-not-ext | 6.7 | Normal prostate | 78-37-4-B2-PU |
| ID864 | est-not-ext | 6.7 | Normal prostate | 78-50-2-E12-PU |
| ID865 | est-not-ext | 6.7 | Hypertrophic prostate | 77-21-2-F8-PU |
| ID866 | est-not-ext | 6.6 | Normal prostate | 78-27-4-E2-PU |
| ID867 | est-not-ext | 6.5 | Normal prostate | 78-45-4-G12-PU |
| ID868 | est-not-ext | 6.3 | Cancerous prostate | 76-7-4-H8-PU |
| ID869 | est-not-ext | 6.3 | Normal prostate | 78-23-1-D10-PU |
| ID870 | est-not-ext | 6.3 | Cancerous prostate | 76-34-1-C2-PU |
| ID871 | est-not-ext | 6.2 | Hypertrophic prostate | 77-8-1-F11-PU |
| ID872 | est-not-ext | 6.2 | Cancerous prostate | 76-41-1-F3-PU |
| ID873 | est-not-ext | 6.1 | Cancerous prostate | 76-22-3-G4-PU |
| ID874 | est-not-ext | 6.1 | Normal prostate | 78-40-1-A6-PU |
| ID875 | est-not-ext | 6 | Normal prostate | 78-41-2-H11-PU |
| ID876 | est-not-ext | 6 | Normal prostate | 78-6-3-A12-PU |
| ID877 | est-not-ext | 6 | Hypertrophic prostate | 77-25-1-A6-PU |
| ID878 | est-not-ext | 5.9 | Hypertrophic prostate | 77-35-2-E4-PU |
| ID879 | est-not-ext | 5.9 | Hypertrophic prostate | 77-36-1-G4-PU |
| ID880 | est-not-ext | 5.8 | Hypertrophic prostate | 77-40-3-D6-PU |
| ID881 | est-not-ext | 5.8 | Normal prostate | 78-17-3-A3-PU |
| ID882 | est-not-ext | 5.7 | Normal prostate | 78-33-3-D7-PU |
| ID883 | est-not-ext | 5.7 | Hypertrophic prostate | 77-23-4-E10-PU |
| ID884 | est-not-ext | 5.7 | Cancerous prostate | 76-25-4-F11-PU |
| ID885 | est-not-ext | 5.7 | Cancerous prostate | 76-33-2-F8-PU |
| ID886 | est-not-ext | 5.7 | Normal prostate | 78-47-4-D6-PU |
| ID887 | est-not-ext | 5.7 | Normal prostate | 78-34-4-G6-PU |
| ID888 | est-not-ext | 5.6 | Cancerous prostate | 76-23-3-G8-PU |
| ID889 | est-not-ext | 5.6 | Normal prostate | 78-41-1-A6-PU |
| ID890 | est-not-ext | 5.6 | Cancerous prostate | 76-38-1-E4-PU |
| ID891 | est-not-ext | 5.5 | Normal prostate | 78-2-4-F11-PU |
| ID892 | est-not-ext | 5.4 | Cancerous prostate | 76-13-3-A9-PU |
| ID893 | est-not-ext | 5.4 | Normal prostate | 78-7-3-D9-PU |
| ID894 | est-not-ext | 5.2 | Cancerous prostate | 76-6-2-G5-PU |
| ID895 | est-not-ext | 5.1 | Hypertrophic prostate | 77-39-4-H4-PU |
| ID896 | est-not-ext | 5 | Hypertrophic prostate | 77-13-3-F1-PU |
| ID897 | est-not-ext | 5 | Normal prostate | 78-24-4-A4-PU |
| ID898 | est-not-ext | 4.9 | Hypertrophic prostate | 77-1-2-B4-PU |
| ID899 | est-not-ext | 4.9 | Cancerous prostate | 76-42-2-F3-PU |
| ID900 | est-not-ext | 4.9 | Cancerous prostate | 76-40-3-G6-PU |
| ID901 | est-not-ext | 4.8 | Cancerous prostate | 76-44-1-E3-PU |
| ID902 | est-not-ext | 4.8 | Hypertrophic prostate | 77-3-4-H1-PU |
| ID903 | est-not-ext | 4.8 | Cancerous prostate | 76-45-2-C4-PU |
| ID904 | est-not-ext | 4.8 | Prostate | 60-12-1-D7-PU |
| ID905 | est-not-ext | 4.8 | Normal prostate | 78-46-2-B4-PU |
| ID906 | est-not-ext | 4.7 | Prostate | 60-12-3-A7-PU |
| ID907 | est-not-ext | 4.7 | Normal prostate | 78-24-3-A8-PU |
| ID908 | est-not-ext | 4.6 | Hypertrophic prostate | 77-17-3-A7-PU |
| ID909 | est-not-ext | 4.6 | Hypertrophic prostate | 77-10-1-F6-PU |
| ID910 | est-not-ext | 4.5 | Prostate | 60-13-1-E11-PU |
| ID911 | est-not-ext | 4.4 | Normal prostate | 78-24-3-C6-PU |
| ID912 | est-not-ext | 4.4 | Cancerous prostate | 76-23-1-B4-PU |
| ID913 | est-not-ext | 4.3 | Hypertrophic prostate | 77-9-1-E2-PU |
| ID914 | est-not-ext | 4.2 | Normal prostate | 78-4-4-B10-PU |
| ID915 | est-not-ext | 4.2 | Normal prostate | 78-30-2-C1-PU |
| ID916 | est-not-ext | 4.2 | Normal prostate | 78-38-2-E9-PU |
| ID917 | est-not-ext | 4.2 | Normal prostate | 78-8-2-F2-PU |
| ID918 | est-not-ext | 4.1 | Cancerous prostate | 76-20-3-H1-PU |
| ID919 | est-not-ext | 4.1 | Cancerous prostate | 76-14-1-B3-PU |
| ID920 | est-not-ext | 4.1 | Normal prostate | 78-18-4-D6-PU |
| ID921 | est-not-ext | 4 | Hypertrophic prostate | 77-11-4-B3-PU |
| ID922 | est-not-ext | 4 | Normal prostate | 78-16-2-C2-PU |
| ID923 | est-not-ext | 4 | Hypertrophic prostate | 77-38-2-G5-PU |
| ID924 | est-not-ext | 3.9 | Normal prostate | 78-25-1-H11-PU |
| ID925 | est-not-ext | 3.9 | Hypertrophic prostate | 77-12-3-H7-PU |
| ID926 | est-not-ext | 3.8 | Cancerous prostate | 76-21-4-A3-PU |
| ID927 | est-not-ext | 3.8 | Normal prostate | 78-41-1-C6-PU |
| ID928 | est-not-ext | 3.7 | Cancerous prostate | 76-5-2-H11-PU |
| ID929 | est-not-ext | 3.7 | Cancerous prostate | 76-8-4-D9-PU |
| ID930 | est-not-ext | 3.7 | Cancerous prostate | 76-18-2-D4-PU |
| ID931 | est-not-ext | 3.7 | Prostate | 60-12-3-G4-PU |

TABLE II-continued

| SEQ. ID NO. | CATEGORY | VON HEIJNE SCORE | TISSUE SOURCE | INTERNAL DESIGNATION |
|---|---|---|---|---|
| ID932 | est-not-ext | 3.7 | Hypertrophic prostate | 77-20-2-E11-PU |
| ID933 | est-not-ext | 3.6 | Cancerous prostate | 76-1-2-G6-PU |
| ID934 | est-not-ext | 3.6 | Normal prostate | 78-8-3-F2-PU |
| ID935 | est-not-ext | 3.6 | Normal prostate | 78-12-4-E9-PU |
| ID936 | est-not-ext | 3.6 | Hypertrophic prostate | 77-15-2-E2-PU |
| ID937 | est-not-ext | 3.5 | Cancerous prostate | 76-7-3-A12-PU |
| ID938 | est-not-ext | 3.5 | Normal prostate | 78-22-3-E10-PU |
| ID939 | est-not-ext | 3.5 | Hypertrophic prostate | 77-2-3-E11-PU |
| ID940 | est-not-ext | 3.5 | Normal prostate | 78-29-1-B2-PU |
| ID941 | ext-vrt-not-genomic | 12 | Normal prostate | 78-47-2-C1-PU |
| ID942 | ext-vrt-not-genomic | 12 | Normal prostate | 78-43-4-G12-PU |
| ID943 | ext-vrt-not-genomic | 12 | Hypertrophic prostate | 77-38-1-A8-PU |
| ID944 | ext-vrt-not-genomic | 8.9 | Normal prostate | 78-45-4-F12-PU |
| ID945 | ext-vrt-not-genomic | 8.1 | Normal prostate | 78-35-3-D1-PU |
| ID946 | ext-vrt-not-genomic | 7.7 | Normal prostate | 78-10-1-H8-PU |
| ID947 | ext-vrt-not-genomic | 6.9 | Cancerous prostate | 76-43-1-E3-PU |
| ID948 | ext-vrt-not-genomic | 5.9 | Normal prostate | 78-29-2-C10-PU |
| ID949 | ext-vrt-not-genomic | 5.3 | Hypertrophic prostate | 77-38-3-B11-PU |
| ID950 | ext-vrt-not-genomic | 5.1 | Normal prostate | 78-36-4-A8-PU |
| ID951 | new | 13.2 | Testis | 51-39-3-H2-PU |
| ID952 | new | 12 | Testis | 51-34-3-F8-PU |
| ID953 | new | 11 | Testis | 51-43-2-C5-PU |
| ID954 | new | 10.6 | Testis | 51-2-4-C4-PU |
| ID955 | new | 10.4 | Ovary | 26-49-1-A5-PU |
| ID956 | new | 10.1 | Testis | 51-3-3-B10-PU |
| ID957 | new | 9.8 | Testis | 51-15-4-A12-PU |
| ID958 | new | 9.8 | Testis | 51-14-1-G6-PU |
| ID959 | new | 9.5 | Spleen | 53-1-4-A1-PU |
| ID960 | new | 9.4 | Ovary | 26-40-1-A11-PU |
| ID961 | new | 9.4 | Testis | 51-19-4-A10-PU |
| ID962 | new | 9.2 | Ovary | 26-25-2-D2-PU |
| ID963 | new | 9.2 | Testis | 51-17-2-C6-PU |
| ID964 | new | 9.2 | Ovary | 26-40-3-A6-PU |
| ID965 | new | 9.1 | Ovary | 26-49-1-A9-PU |
| ID966 | new | 9.1 | Spleen | 20-7-2-D6-PU |
| ID967 | new | 9.1 | Testis | 51-2-1-A11-PU |
| ID968 | new | 9 | Testis | 51-43-3-G3-PU |
| ID969 | new | 8.9 | Ovary | 26-47-2-B1-PU |
| ID970 | new | 8.8 | Ovary | 26-11-1-G8-PU |
| ID971 | new | 8.8 | Testis | 51-37-4-E11-PU |
| ID972 | new | 8.7 | Ovary | 26-25-2-G1-PU |
| ID973 | new | 8.5 | Testis | 51-13-1-F7-PU |
| ID974 | new | 8.4 | Spleen | 20-2-1-D7-PU |
| ID975 | new | 8.1 | Ovary | 26-12-2-B5-PU |
| ID976 | new | 8 | Testis | 51-1-1-G12-PU |
| ID977 | new | 7.6 | Spleen | 20-8-2-F3-PU |
| ID978 | new | 7.5 | Spleen | 20-10-3-D4-PU |
| ID979 | new | 7.5 | Spleen | 20-3-3-G4-PU |
| ID980 | new | 7.5 | Testis | 51-10-3-B6-PU |
| ID981 | new | 7.5 | Ovary | 26-27-3-E8-PU |
| ID982 | new | 7.4 | Testis | 51-44-4-A6-PU |
| ID983 | new | 7.3 | Testis | 51-7-2-A6-PU |
| ID984 | new | 7.3 | Ovary | 26-31-1-D11-PU |
| ID985 | new | 7.1 | Testis | 51-28-2-G1-PU |
| ID986 | new | 6.9 | Spleen | 20-10-1-B12-PU |
| ID987 | new | 6.9 | Testis | 51-39-1-A5-PU |
| ID988 | new | 6.9 | Ovary | 26-23-2-A11-PU |
| ID989 | new | 6.9 | Testis | 51-1-4-C5-PU |
| ID990 | new | 6.8 | Spleen | 53-2-4-D8-PU |
| ID991 | new | 6.8 | Spleen | 20-3-2-C11-PU |
| ID992 | new | 6.8 | Testis | 51-29-4-B4-PU |
| ID993 | new | 6.8 | Ovary | 26-27-3-E11-PU |
| ID994 | new | 6.6 | Ovary | 26-10-1-H8-PU |
| ID995 | new | 6.5 | Testis | 51-18-2-G10-PU |
| ID996 | new | 6.5 | Spleen | 20-2-1-H12-PU |
| ID997 | new | 6.4 | Testis | 51-10-3-G3-PU |
| ID998 | new | 6.4 | Uterus | 74-9-4-H2-PU |
| ID999 | new | 6.4 | Ovary | 26-23-3-G2-PU |
| ID1000 | new | 6.4 | Testis | 51-2-4-F5-PU |
| ID1001 | new | 6.4 | Uterus | 74-4-3-C4-PU |
| ID1002 | new | 6.3 | Testis | 51-31-3-D1-PU |
| ID1003 | new | 6.3 | Spleen | 20-5-1-H1-PU |
| ID1004 | new | 6.2 | Ovary | 26-41-1-G3-PU |
| ID1005 | new | 6.2 | Uterus | 74-11-4-G3-PU |
| ID1006 | new | 6.1 | Ovary | 26-4-4-E9-PU |
| ID1007 | new | 6.1 | Spleen | 20-2-3-C2-PU |

TABLE II-continued

| SEQ. ID NO. | CATEGORY | VON HEIJNE SCORE | TISSUE SOURCE | INTERNAL DESIGNATION |
|---|---|---|---|---|
| ID1008 | new | 6.1 | Ovary | 26-48-1-A9-PU |
| ID1009 | new | 6 | Spleen | 20-1-2-C7-PU |
| ID1010 | new | 6 | Ovary | 26-28-4-H1-PU |
| ID1011 | new | 6 | Uterus | 74-8-4-C11-PU |
| ID1012 | new | 6 | Ovary | 26-6-3-B9-PU |
| ID1013 | new | 5.9 | Testis | 51-16-4-B10-PU |
| ID1014 | new | 5.9 | Testis | 51-47-3-F9-PU |
| ID1015 | new | 5.9 | Testis | 51-4-2-D10-PU |
| ID1016 | new | 5.9 | Ovary | 26-10-4-D9-PU |
| ID1017 | new | 5.8 | Testis | 51-18-1-C3-PU |
| ID1018 | new | 5.8 | Ovary | 26-45-2-C4-PU |
| ID1019 | new | 5.7 | Ovary | 26-26-3-D7-PU |
| ID1020 | new | 5.7 | Ovary | 26-5-3-A8-PU |
| ID1021 | new | 5.7 | Ovary | 26-47-1-C6-PU |
| ID1022 | new | 5.6 | Testis | 51-19-1-F10-PU |
| ID1023 | new | 5.6 | Testis | 51-11-4-G10-PU |
| ID1024 | new | 5.5 | Testis | 51-39-3-F7-PU |
| ID1025 | new | 5.5 | Testis | 51-2-1-E10-PU |
| ID1026 | new | 5.4 | Testis | 51-26-2-F5-PU |
| ID1027 | new | 5.4 | Ovary | 26-2-2-G10-PU |
| ID1028 | new | 5.4 | Testis | 51-35-4-G9-PU |
| ID1029 | new | 5.4 | Ovary | 26-39-1-A6-PU |
| ID1030 | new | 5.3 | Ovary | 26-47-1-E2-PU |
| ID1031 | new | 5.3 | Testis | 51-26-2-C7-PU |
| ID1032 | new | 5.2 | Uterus | 74-11-3-F8-PU |
| ID1033 | new | 5.2 | Spleen | 53-3-1-E2-PU |
| ID1034 | new | 5.2 | Testis | 51-31-3-G12-PU |
| ID1035 | new | 5.1 | Spleen | 20-6-4-G5-PU |
| ID1036 | new | 5.1 | Uterus | 74-6-3-F1-PU |
| ID1037 | new | 5.1 | Uterus | 74-11-1-F8-PU |
| ID1038 | new | 5.1 | Ovary | 26-7-4-B3-PU |
| ID1039 | new | 5 | Ovary | 26-5-3-F10-PU |
| ID1040 | new | 5 | Ovary | 26-49-3-C2-PU |
| ID1041 | new | 5 | Testis | 51-29-3-E1-PU |
| ID1042 | new | 5 | Ovary | 26-26-3-D2-PU |
| ID1043 | new | 5 | Uterus | 74-9-4-B4-PU |
| ID1044 | new | 5 | Testis | 51-1-3-E9-PU |
| ID1045 | new | 4.9 | Ovary | 26-5-1-C6-PU |
| ID1046 | new | 4.9 | Ovary | 26-3-1-H5-PU |
| ID1047 | new | 4.9 | Ovary | 26-51-4-D9-PU |
| ID1048 | new | 4.9 | Ovary | 26-27-3-D7-PU |
| ID1049 | new | 4.8 | Uterus | 74-3-4-D8-PU |
| ID1050 | new | 4.8 | Ovary | 26-29-1-E1-PU |
| ID1051 | new | 4.8 | Spleen | 20-3-1-H3-PU |
| ID1052 | new | 4.8 | Testis | 51-3-3-D8-PU |
| ID1053 | new | 4.8 | Spleen | 20-5-3-D9-PU |
| ID1054 | new | 4.7 | Testis | 51-44-4-HA-PU |
| ID1055 | new | 4.7 | Testis | 51-5-4-G12-PU |
| ID1056 | new | 4.7 | Spleen | 20-9-2-F7-PU |
| ID1057 | new | 4.7 | Spleen | 53-3-2-A10-PU |
| ID1058 | new | 4.6 | Ovary | 26-30-4-C1-PU |
| ID1059 | new | 4.6 | Testis | 51-29-3-H6-PU |
| ID1060 | new | 4.6 | Testis | 51-5-3-G2-PU |
| ID1061 | new | 4.6 | Testis | 51-11-3-D5-PU |
| ID1062 | new | 4.6 | Testis | 51-7-1-E7-PU |
| ID1063 | new | 4.6 | Testis | 51-27-1-G12-PU |
| ID1064 | new | 4.6 | Uterus | 74-4-1-F5-PU |
| ID1065 | new | 4.5 | Ovary | 26-24-1-F8-PU |
| ID1066 | new | 4.5 | Spleen | 20-7-3-F6-PU |
| ID1067 | new | 4.5 | Ovary | 26-1-2-A8-PU |
| ID1068 | new | 4.4 | Testis | 51-1-3-H9-PU |
| ID1069 | new | 4.4 | Testis | 51-27-1-E8-PU |
| ID1070 | new | 4.3 | Testis | 51-44-4-B2-PU |
| ID1071 | new | 4.3 | Ovary | 26-44-1-C3-PU |
| ID1072 | new | 4.3 | Spleen | 20-4-2-E2-PU |
| ID1073 | new | 4.3 | Testis | 51-19-4-F5-PU |
| ID1074 | new | 4.3 | Spleen | 20-8-4-D7-PU |
| ID1075 | new | 4.3 | Testis | 51-24-1-B11-PU |
| ID1076 | new | 4.3 | Spleen | 20-6-2-G10-PU |
| ID1077 | new | 4.2 | Testis | 51-6-4-F8-PU |
| ID1078 | new | 4.2 | Testis | 51-36-2-A9-PU |
| ID1079 | new | 4.2 | Ovary | 26-7-3-H10-PU |
| ID1080 | new | 4.2 | Testis | 51-1-3-D9-PU |
| ID1081 | new | 4.2 | Spleen | 20-2-1-B11-PU |
| ID1082 | new | 4.2 | Uterus | 74-6-4-A5-PU |
| ID1083 | new | 4.2 | Testis | 51-14-3-F3-PU |

TABLE II-continued

| SEQ. ID NO. | CATEGORY | VON HEIJNE SCORE | TISSUE SOURCE | INTERNAL DESIGNATION |
|---|---|---|---|---|
| ID1084 | new | 4.1 | Ovary | 26-33-3-E2-PU |
| ID1085 | new | 4 | Testis | 51-26-4-C7-PU |
| ID1086 | new | 4 | Testis | 51-25-3-F3-PU |
| ID1087 | new | 4 | Ovary | 26-8-3-D5-PU |
| ID1088 | new | 4 | Testis | 51-42-3-F9-PU |
| ID1089 | new | 4 | Ovary | 26-27-1-C5-PU |
| ID1090 | new | 4 | Ovary | 26-1-1-G2-PU |
| ID1091 | new | 3.9 | Ovary | 26-8-3-H3-PU |
| ID1092 | new | 3.9 | Ovary | 26-40-2-A9-PU |
| ID1093 | new | 3.9 | Ovary | 26-24-4-A5-PU |
| ID1094 | new | 3.9 | Uterus | 74-5-3-B12-PU |
| ID1095 | new | 3.8 | Testis | 51-37-2-G12-PU |
| ID1096 | new | 3.8 | Spleen | 20-8-2-E7-PU |
| ID1097 | new | 3.8 | Testis | 51-2-1-H9-PU |
| ID1098 | new | 3.8 | Ovary | 26-46-4-D12-PU |
| ID1099 | new | 3.8 | Ovary | 26-40-1-A12-PU |
| ID1100 | new | 3.7 | Testis | 51-3-4-E2-PU |
| ID1101 | new | 3.7 | Ovary | 26-47-3-G12-PU |
| ID1102 | new | 3.7 | Ovary | 26-2-4-E12-PU |
| ID1103 | new | 3.7 | Uterus | 74-4-4-D6-PU |
| ID1104 | new | 3.7 | Testis | 51-36-4-A3-PU |
| ID1105 | new | 3.7 | Uterus | 74-11-1-B8-PU |
| ID1106 | new | 3.7 | Spleen | 20-10-2-G2-PU |
| ID1107 | new | 3.7 | Testis | 51-37-4-D6-PU |
| ID1108 | new | 3.6 | Ovary | 26-27-4-G9-PU |
| ID1109 | new | 3.6 | Testis | 51-2-3-A6-PU |
| ID1110 | new | 3.6 | Ovary | 26-24-2-A3-PU |
| ID1111 | new | 3.6 | Uterus | 74-3-3-F6-PU |
| ID1112 | new | 3.5 | Spleen | 20-10-2-B2-PU |
| ID1113 | new | 3.5 | Testis | 51-13-2-G2-PU |
| ID1114 | new | 3.5 | Testis | 51-17-4-A4-PU |
| ID1115 | new | 3.5 | Spleen | 20-10-3-E5-PU |
| ID1116 | new | 3.5 | Testis | 51-30-1-B6-PU |
| ID1117 | new | 3.5 | Ovary | 26-40-2-G12-PU |
| ID1118 | new | 3.5 | Ovary | 26-9-3-G4-PU |
| ID1119 | ext-est-not-vrt | 12.7 | Testis | 51-18-4-A4-PU |
| ID1120 | ext-est-not-vrt | 7.4 | Ovary | 26-44-1-B5-PU |
| ID1121 | ext-est-not-vrt | 7.3 | Testis | 51-20-1-A2-PU |
| ID1122 | ext-est-not-vrt | 7.1 | Ovary | 26-2-1-A12-PU |
| ID1123 | ext-est-not-vrt | 6.7 | Testis | 51-2-1-A7-PU |
| ID1124 | ext-est-not-vrt | 5.6 | Spleen | 53-1-1-C10-PU |
| ID1125 | ext-est-not-vrt | 5.6 | Uterus | 74-10-1-B10-PU |
| ID1126 | ext-est-not-vrt | 5.3 | Testis | 51-31-4-A1-PU |
| ID1127 | ext-est-not-vrt | 4.4 | Testis | 51-25-1-A2-PU |
| ID1128 | ext-est-not-vrt | 4.1 | Testis | 51-35-2-F8-PU |
| ID1129 | ext-est-not-vrt | 3.9 | Testis | 51-8-3-E7-PU |
| ID1130 | ext-est-not-vrt | 3.9 | Testis | 51-34-2-H6-PU |
| ID1131 | ext-est-not-vrt | 3.5 | Uterus | 74-7-2-F11-PU |
| ID1132 | est-not-ext | 10.5 | Testis | 51-18-1-G7-PU |
| ID1133 | est-not-ext | 9.5 | Testis | 51-23-1-G1-PU |
| ID1134 | est-not-ext | 8.3 | Ovary | 26-8-1-B12-PU |
| ID1135 | est-not-ext | 8.3 | Testis | 51-41-1-F10-PU |
| ID1136 | est-not-ext | 8.2 | Ovary | 26-12-1-A2-PU |
| ID1137 | est-not-ext | 8.1 | Spleen | 53-3-3-B8-PU |
| ID1138 | est-not-ext | 8 | Testis | 51-4-4-A12-PU |
| ID1139 | est-not-ext | 7.8 | Testis | 51-18-1-H7-PU |
| ID1140 | est-not-ext | 7.6 | Spleen | 20-6-4-G3-PU |
| ID1141 | est-not-ext | 7.5 | Testis | 51-2-3-F10-PU |
| ID1142 | est-not-ext | 7.1 | Testis | 51-7-2-C2-PU |
| ID1143 | est-not-ext | 7.1 | Testis | 51-6-4-F9-PU |
| ID1144 | est-not-ext | 6.5 | Spleen | 20-6-1-D11-PU |
| ID1145 | est-not-ext | 6.4 | Ovary | 26-26-1-A11-PU |
| ID1146 | est-not-ext | 6.4 | Testis | 51-9-3-A12-PU |
| ID1147 | est-not-ext | 6.2 | Ovary | 26-8-3-F5-PU |
| ID1148 | est-not-ext | 6.1 | Ovary | 26-27-2-A12-PU |
| ID1149 | est-not-ext | 6 | Uterus | 74-11-3-H4-PU |
| ID1150 | est-not-ext | 5.8 | Ovary | 26-51-2-G10-PU |
| ID1151 | est-not-ext | 5.8 | Testis | 51-23-1-G2-PU |
| ID1152 | est-not-ext | 5.7 | Uterus | 74-1-2-H1-PU |
| ID1153 | est-not-ext | 5.7 | Testis | 51-9-1-E7-PU |
| ID1154 | est-not-ext | 5.3 | Testis | 51-1-4-E9-PU |
| ID1155 | est-not-ext | 4.8 | Testis | 51-6-4-G2-PU |
| ID1156 | est-not-ext | 4.8 | Spleen | 20-2-1-C5-PU |
| ID1157 | est-not-ext | 4.7 | Testis | 51-23-1-H2-PU |
| ID1158 | est-not-ext | 4.6 | Testis | 51-19-3-H6-PU |
| ID1159 | est-not-ext | 4.6 | Testis | 51-10-3-D11-PU |

TABLE II-continued

| SEQ. ID NO. | CATEGORY | VON HEIJNE SCORE | TISSUE SOURCE | INTERNAL DESIGNATION |
|---|---|---|---|---|
| ID1160 | est-not-ext | 4.6 | Testis | 51-20-2-G7-PU |
| ID1161 | est-not-ext | 4.6 | Ovary | 26-38-4-C2-PU |
| ID1162 | est-not-ext | 4.5 | Ovary | 26-44-3-C5-PU |
| ID1163 | est-not-ext | 4.4 | Ovary | 26-47-4-H1-PU |
| ID1164 | est-not-ext | 4.4 | Spleen | 20-5-2-C3-PU |
| ID1165 | est-not-ext | 4.3 | Testis | 51-21-3-B10-PU |
| ID1166 | est-not-ext | 4.3 | Spleen | 20-4-4-B3-PU |
| ID1167 | est-not-ext | 4.2 | Ovary | 26-5-1-F8-PU |
| ID1168 | est-not-ext | 4.1 | Testis | 51-22-3-B10-PU |
| ID1169 | est-not-ext | 4.1 | Testis | 51-18-1-G1-PU |
| ID1170 | est-not-ext | 4.1 | Testis | 51-12-2-H4-PU |
| ID1171 | est-not-ext | 3.9 | Testis | 51-25-1-A12-PU |
| ID1172 | est-not-ext | 3.8 | Spleen | 20-2-1-B4-PU |
| ID1173 | est-not-ext | 3.8 | Spleen | 20-7-2-A6-PU |
| ID1174 | est-not-ext | 3.8 | Ovary | 26-27-4-D3-PU |
| ID1175 | est-not-ext | 3.8 | Ovary | 26-5-4-F9-PU |
| ID1176 | est-not-ext | 3.8 | Uterus | 74-3-1-B9-PU |
| ID1177 | est-not-ext | 3.7 | Spleen | 20-8-4-A11-PU |
| ID1178 | est-not-ext | 3.6 | Testis | 51-15-4-G10-PU |
| ID1179 | est-not-ext | 3.6 | Testis | 51-2-1-A10-PU |
| ID1180 | est-not-ext | 3.5 | Spleen | 53-1-1-A10-PU |
| ID1181 | est-not-ext | 3.5 | Testis | 51-15-4-H10-PU |
| ID1182 | ext-vrt-not-genomic | 8.1 | Ovary | 26-36-1-D11-PU |
| ID1183 | ext-vrt-not-genomic | 4 | Testis | 51-39-2-D9-PU |
| ID1184 | new | 15.8 | Fetal liver | 65-5-1-C9-PU |
| ID1185 | new | 11.4 | Lung (cells) | 30-4-2-A11-PU |
| ID1186 | new | 11.1 | Large intestine | 83-3-2-H8-PU |
| ID1187 | new | 10.4 | Pancreas | 19-8-1-F2 |
| ID1188 | new | 10 | Liver | 22-11-2-H9-PU |
| ID1189 | new | 9.4 | Lung (cells) | 30-12-1-H1-PU |
| ID1190 | new | 9.2 | Lung | 59-1-3-E7-PU |
| ID1191 | new | 9.1 | Large intestine | 83-2-2-D9-PU |
| ID1192 | new | 9 | Lung (cells) | 30-2-1-G4-PU |
| ID1193 | new | 8.9 | Colon | 23-11-3-C4-PU |
| ID1194 | new | 8.9 | Large intestine | 83-2-1-C3-PU |
| ID1195 | new | 8.6 | Lung (cells) | 30-3-2-H6-PU |
| ID1196 | new | 8.6 | Lung (cells) | 30-13-1-D9-PU |
| ID1197 | new | 8.6 | Colon | 23-1-4-E6-PU |
| ID1198 | new | 8.2 | Liver | 22-3-3-C4-PU |
| ID1199 | new | 8 | Pancreas | 19-4-4-H9 |
| ID1200 | new | 7.7 | Lung (cells) | 30-8-1-F2-PU |
| ID1201 | new | 7.5 | Lung (cells) | 30-6-1-B1-PU |
| ID1202 | new | 7.5 | Lung (cells) | 30-6-3-H1-PU |
| ID1203 | new | 7.5 | Colon | 23-10-3-F10-PU |
| ID1204 | new | 7.4 | Lung | 42-1-1-E3-PU |
| ID1205 | new | 7.3 | Lung | 42-3-3-B1-PU |
| ID1206 | new | 7.3 | Lung | 42-3-4-B1-PU |
| ID1207 | new | 7.2 | Lung | 59-9-2-E6-PU |
| ID1208 | new | 7 | Thyroid | 84-4-2-D2-PU |
| ID1209 | new | 7 | Lung (cells) | 30-8-3-E3-PU |
| ID1210 | new | 7 | Lung | 59-9-4-A10-PU |
| ID1211 | new | 7 | Lung (cells) | 30-10-2-A2-PU |
| ID1212 | new | 6.9 | Lung | 59-9-1-B9-PU |
| ID1213 | new | 6.5 | Fetal liver | 65-4-4-A3-PU |
| ID1214 | new | 6.5 | Lung (cells) | 30-2-1-C8-PU |
| ID1215 | new | 6.4 | Colon | 23-9-4-F2-PU |
| ID1216 | new | 6.4 | Lung (cells) | 30-9-3-A2-PU |
| ID1217 | new | 6.3 | Liver | 22-11-2-A9-PU |
| ID1218 | new | 6.3 | Liver | 22-13-4-G8-PU |
| ID1219 | new | 6.2 | Liver | 22-1-2-A11-PU |
| ID1220 | new | 6.1 | Lung (cells) | 30-6-1-D11-PU |
| ID1221 | new | 5.9 | Thyroid | 84-4-3-A5-PU |
| ID1222 | new | 5.8 | Lung (cells) | 30-5-4-C1-PU |
| ID1223 | new | 5.7 | Liver | 22-5-2-A4-PU |
| ID1224 | new | 5.7 | Lung (cells) | 30-2-4-B7-PU |
| ID1225 | new | 5.6 | Pancreas | 46-3-4-G2-PU |
| ID1226 | new | 5.6 | Thyroid | 84-4-3-E9-PU |
| ID1227 | new | 5.5 | Lung (cells) | 30-7-2-C7-PU |
| ID1228 | new | 5.5 | Lung (cells) | 30-6-3-H11-PU |
| ID1229 | new | 5.5 | Large intestine | 83-5-3-C5-PU |
| ID1230 | new | 5.4 | Pancreas | 19-1-4-D10 |
| ID1231 | new | 5.3 | Lung | 59-5-3-A7-PU |
| ID1232 | new | 5.2 | Lung (cells) | 30-13-1-G11-PU |
| ID1233 | new | 5.2 | Lung (cells) | 30-7-3-E3-PU |
| ID1234 | new | 5.2 | Lung (cells) | 30-9-1-B10-PU |
| ID1235 | new | 5.1 | Lung (cells) | 30-8-1-G2-PU |

TABLE II-continued

| SEQ. ID NO. | CATEGORY | VON HEIJNE SCORE | TISSUE SOURCE | INTERNAL DESIGNATION |
|---|---|---|---|---|
| ID1236 | new | 5.1 | Lung (cells) | 30-13-2-E9-PU |
| ID1237 | new | 5.1 | Thyroid | 84-3-3-B4-PU |
| ID1238 | new | 5 | Lung (cells) | 30-4-4-D2-PU |
| ID1239 | new | 4.9 | Colon | 23-2-4-D1-PU |
| ID1240 | new | 4.9 | Colon | 23-9-1-A7-PU |
| ID1241 | new | 4.9 | Lung (cells) | 30-11-3-E2-PU |
| ID1242 | new | 4.9 | Fetal liver | 65-4-4-C8-PU |
| ID1243 | new | 4.9 | Large intestine | 83-2-4-H6-PU |
| ID1244 | new | 4.8 | Lung (cells) | 30-5-2-G2-PU |
| ID1245 | new | 4.8 | Liver | 22-9-4-B1-PU |
| ID1246 | new | 4.8 | Lung | 42-2-2-F2-PU |
| ID1247 | new | 4.8 | Lung (cells) | 30-1-1-D5-PU |
| ID1248 | new | 4.8 | Thyroid | 84-2-2-G8-PU |
| ID1249 | new | 4.7 | Colon | 23-10-4-H5-PU |
| ID1250 | new | 4.7 | Colon | 23-8-3-B1-PU |
| ID1251 | new | 4.7 | Lung (cells) | 30-8-3-A7-PU |
| ID1252 | new | 4.6 | Lung (cells) | 30-11-2-D9-PU |
| ID1253 | new | 4.5 | Lung (cells) | 30-6-4-E3-PU |
| ID1254 | new | 4.5 | Large intestine | 83-3-2-D3-PU |
| ID1255 | new | 4.5 | Pancreas | 19-2-2-E7 |
| ID1256 | new | 4.4 | Pancreas | 46-1-2-H7-PU |
| ID1257 | new | 4.4 | Colon | 23-1-3-C5-PU |
| ID1258 | new | 4.3 | Lung (cells) | 30-11-2-E12-PU |
| ID1259 | new | 4.3 | Fetal liver | 65-2-3-E3-PU |
| ID1260 | new | 4.3 | Colon | 23-11-1-G5-PU |
| ID1261 | new | 4.2 | Pancreas | 19-2-2-B4 |
| ID1262 | new | 4.2 | Lung (cells) | 30-4-4-H10-PU |
| ID1263 | new | 4.2 | Lung | 42-3-2-F6-PU |
| ID1264 | new | 4.1 | Lung (cells) | 30-1-4-G3-PU |
| ID1265 | new | 4.1 | Pancreas | 19-4-2-F6 |
| ID1266 | new | 4 | Lung | 42-3-3-F2-PU |
| ID1267 | new | 4 | Large intestine | 83-1-3-H10-PU |
| ID1268 | new | 4 | Lung (cells) | 30-11-1-D4-PU |
| ID1269 | new | 4 | Fetal liver | 65-5-1-E9-PU |
| ID1270 | new | 4 | Lung (cells) | 30-2-3-D4-PU |
| ID1271 | new | 4 | Colon | 23-8-4-G8-PU |
| ID1272 | new | 3.9 | Pancreas | 19-1-2-D9 |
| ID1273 | new | 3.9 | Lung (cells) | 30-7-2-D3-PU |
| ID1274 | new | 3.8 | Pancreas | 19-3-3-H4 |
| ID1275 | new | 3.7 | Fetal liver | 65-4-2-F9-PU |
| ID1276 | new | 3.6 | Lung (cells) | 30-3-3-G4-PU |
| ID1277 | new | 3.6 | Fetal liver | 65-5-2-C3-PU |
| ID1278 | new | 3.6 | Liver | 52-3-2-B1-PU |
| ID1279 | new | 3.6 | Large intestine | 83-2-2-B12-PU |
| ID1280 | new | 3.6 | Liver | 22-10-4-C1-PU |
| ID1281 | new | 3.6 | Thyroid | 84-4-1-H8-PU |
| ID1282 | new | 3.6 | Lung (cells) | 30-13-4-B11-PU |
| ID1283 | new | 3.6 | Lung (cells) | 30-13-1-G12-PU |
| ID1284 | new | 3.5 | Pancreas | 46-1-4-E11-PU |
| ID1285 | new | 3.5 | Thyroid | 84-1-3-C10-PU |
| ID1286 | new | 3.5 | Thyroid | 84-4-4-H11-PU |
| ID1287 | new | 3.5 | Lung | 59-8-3-A1-PU |
| ID1288 | ext-est-not-vrt | 7.6 | Large intestine | 83-4-2-H4-PU |
| ID1289 | ext-est-not-vrt | 6.6 | Lung (cells) | 30-2-2-C3-PU |
| ID1290 | ext-est-not-vrt | 6.6 | Thyroid | 84-4-1-F7-PU |
| ID1291 | ext-est-not-vrt | 5.4 | Pancreas | 19-10-1-C2 |
| ID1292 | ext-est-not-vrt | 5.2 | Thyroid | 84-5-1-F9-PU |
| ID1293 | ext-est-not-vrt | 5 | Lung | 59-9-3-A5-PU |
| ID1294 | ext-est-not-vrt | 4.7 | Lung (cells) | 30-7-3-H4-PU |
| ID1295 | ext-est-not-vrt | 4.5 | Lung (cells) | 30-11-3-F3-PU |
| ID1296 | ext-est-not-vrt | 4.4 | Lung (cells) | 30-12-1-D12-PU |
| ID1297 | est-not-ext | 16.4 | Liver | 22-5-3-G5-PU |
| ID1298 | est-not-ext | 14.4 | Large intestine | 83-3-2-E8-PU |
| ID1299 | est-not-ext | 10.3 | Liver | 52-3-1-B1-PU |
| ID1300 | est-not-ext | 9.5 | Pancreas | 19-9-1-C4 |
| ID1301 | est-not-ext | 9.5 | Pancreas | 19-8-4-F5-PU |
| ID1302 | est-not-ext | 8.8 | Colon | 23-2-1-D11-PU |
| ID1303 | est-not-ext | 8.7 | Large intestine | 83-4-4-B11-PU |
| ID1304 | est-not-ext | 8.5 | Liver | 22-13-3-F7-PU |
| ID1305 | est-not-ext | 8.1 | Lung | 42-2-3-A4-PU |
| ID1306 | est-not-ext | 7.6 | Liver | 22-10-3-C3-PU |
| ID1307 | est-not-ext | 7.5 | Lung (cells) | 30-5-1-B12-PU |
| ID1308 | est-not-ext | 7.5 | Liver | 52-1-2-B3-PU |
| ID1309 | est-not-ext | 6.8 | Pancreas | 19-8-3-B2 |
| ID1310 | est-not-ext | 6.8 | Lung | 59-1-3-A4-PU |
| ID1311 | est-not-ext | 6.8 | Thyroid | 84-3-1-F10-PU |

TABLE II-continued

| SEQ. ID NO. | CATEGORY | VON HEIJNE SCORE | TISSUE SOURCE | INTERNAL DESIGNATION |
|---|---|---|---|---|
| ID1312 | est-not-ext | 6.1 | Lung (cells) | 30-12-4-B11-PU |
| ID1313 | est-not-ext | 5.9 | Lung (cells) | 30-2-4-B6-PU |
| ID1314 | est-not-ext | 5.7 | Thyroid | 84-4-2-D5-PU |
| ID1315 | est-not-ext | 5.7 | Fetal liver | 65-2-1-E6-PU |
| ID1316 | est-not-ext | 5.6 | Large intestine | 83-5-4-E3-PU |
| ID1317 | est-not-ext | 5.3 | Lung (cells) | 30-9-3-E12-PU |
| ID1318 | est-not-ext | 5 | Colon | 23-10-3-G8-PU |
| ID1319 | est-not-ext | 4.9 | Lung (cells) | 30-10-3-H3-PU |
| ID1320 | est-not-ext | 4.7 | Pancreas | 19-3-4-F4 |
| ID1321 | est-not-ext | 4.5 | Colon | 23-8-3-H9-PU |
| ID1322 | est-not-ext | 4.3 | Large intestine | 83-5-4-A4-PU |
| ID1323 | est-not-ext | 3.8 | Pancreas | 19-1-3-E11 |
| ID1324 | est-not-ext | 3.8 | Lung | 59-5-4-A8-PU |
| ID1325 | est-not-ext | 3.7 | Fetal liver | 65-4-4-H3-PU |
| ID1326 | est-not-ext | 3.7 | Lung | 42-2-1-A1-PU |
| ID1327 | est-not-ext | 3.6 | Liver | 22-6-2-C1-PU |
| ID1328 | est-not-ext | 3.5 | Pancreas | 46-1-2-B2-PU |
| ID1329 | est-not-ext | 3.5 | Colon | 23-12-2-G6-PU |
| ID1330 | est-not-ext | 3.5 | Lung (cells) | 30-11-2-H2-PU |
| ID1331 | new | 15.8 | Heart | 25-13-1-H10-PU |
| ID1332 | new | 14 | Fetal kidney | 58-47-2-B11-PU |
| ID1333 | new | 12.3 | Dystrophic muscle | 29-3-3-H8-PU |
| ID1334 | new | 12.2 | Fetal kidney | 58-4-2-A3-PU |
| ID1335 | new | 11.9 | Kidney | 21-10-4-G1-PU |
| ID1336 | new | 11.3 | Fetal kidney | 58-27-3-B10-PU |
| ID1337 | new | 10.7 | Fetal kidney | 58-35-2-F10-PU |
| ID1338 | new | 10.7 | Fetal kidney | 58-37-2-G10-PU |
| ID1339 | new | 10.6 | Dystrophic muscle | 29-11-1-C11-PU |
| ID1340 | new | 10 | Fetal kidney | 58-20-4-G7-PU |
| ID1341 | new | 10 | Fetal kidney | 58-2-4-E9-PU |
| ID1342 | new | 9.6 | Fetal kidney | 58-37-3-D8-PU |
| ID1343 | new | 9.5 | Fetal kidney | 58-46-1-F1-PU |
| ID1344 | new | 9.2 | Dystrophic muscle | 29-9-4-D8-PU |
| ID1345 | new | 9.2 | Muscle | 27-10-4-C6-PU |
| ID1346 | new | 8.3 | Heart | 67-5-4-H9-PU |
| ID1347 | new | 8.1 | Fetal kidney | 58-4-3-H4-PU |
| ID1348 | new | 8 | Muscle | 27-16-3-D12-PU |
| ID1349 | new | 7.9 | Fetal kidney | 58-54-2-C2-PU |
| ID1350 | new | 7.9 | Heart | 25-9-3-A3-PU |
| ID1351 | new | 7.9 | Dystrophic muscle | 29-11-3-F1-PU |
| ID1352 | new | 7.9 | Fetal kidney | 58-32-3-G6-PU |
| ID1353 | new | 7.8 | Fetal kidney | 58-22-2-H8-PU |
| ID1354 | new | 7.8 | Fetal kidney | 58-2-4-H4-PU |
| ID1355 | new | 7.8 | Heart | 67-4-3-G3-PU |
| ID1356 | new | 7.8 | Fetal kidney | 58-24-1-G11-PU |
| ID1357 | new | 7.7 | Fetal kidney | 58-19-3-H1-PU |
| ID1358 | new | 7.5 | Fetal kidney | 58-45-4-B11-PU |
| ID1359 | new | 7.3 | Fetal kidney | 58-44-2-D3-PU |
| ID1360 | new | 7.2 | Dystrophic muscle | 29-3-3-E7-PU |
| ID1361 | new | 7.1 | Dystrophic muscle | 29-12-3-A3-PU |
| ID1362 | new | 7.1 | Fetal kidney | 58-14-2-B3-PU |
| ID1363 | new | 7.1 | Fetal kidney | 58-10-3-D12-PU |
| ID1364 | new | 7 | Fetal kidney | 58-6-2-E5-PU |
| ID1365 | new | 7 | Dystrophic muscle | 29-7-1-C1-PU |
| ID1366 | new | 6.9 | Fetal kidney | 58-26-4-A12-PU |
| ID1367 | new | 6.9 | Fetal kidney | 58-7-2-H9-PU |
| ID1368 | new | 6.9 | Fetal kidney | 58-14-2-D5-PU |
| ID1369 | new | 6.7 | Fetal kidney | 58-3-4-E1-PU |
| ID1370 | new | 6.7 | Fetal kidney | 58-43-4-G3-PU |
| ID1371 | new | 6.7 | Fetal kidney | 58-11-1-G10-PU |
| ID1372 | new | 6.6 | Fetal kidney | 58-4-4-G2-PU |
| ID1373 | new | 6.6 | Fetal kidney | 58-41-3-D6-PU |
| ID1374 | new | 6.6 | Heart | 25-8-2-H10-PU |
| ID1375 | new | 6.5 | Muscle | 27-18-4-E5-PU |
| ID1376 | new | 6.4 | Dystrophic muscle | 29-4-1-G6-PU |
| ID1377 | new | 6.4 | Muscle | 27-10-2-B1-PU |
| ID1378 | new | 6.4 | Fetal kidney | 58-38-1-E5-PU |
| ID1379 | new | 6.3 | Muscle | 27-4-3-D9-PU |
| ID1380 | new | 6.3 | Fetal kidney | 58-53-1-G1-PU |
| ID1381 | new | 6.3 | Fetal kidney | 58-7-3-F6-PU |
| ID1382 | new | 6.3 | Heart | 25-7-2-B12-PU |
| ID1383 | new | 6.1 | Fetal kidney | 58-16-3-E11-PU |
| ID1384 | new | 6 | Fetal kidney | 58-15-4-C2-PU |
| ID1385 | new | 6 | Fetal kidney | 58-34-3-A9-PU |
| ID1386 | new | 5.9 | Fetal kidney | 58-16-1-E1-PU |
| ID1387 | new | 5.9 | Fetal kidney | 58-4-3-E6-PU |

TABLE II-continued

| SEQ. ID NO. | CATEGORY | VON HEIJNE SCORE | TISSUE SOURCE | INTERNAL DESIGNATION |
|---|---|---|---|---|
| ID1388 | new | 5.9 | Fetal kidney | 58-37-3-B11-PU |
| ID1389 | new | 5.9 | Fetal kidney | 58-35-3-C6-PU |
| ID1390 | new | 5.8 | Fetal kidney | 58-35-1-D9-PU |
| ID1391 | new | 5.8 | Fetal kidney | 58-26-3-B2-PU |
| ID1392 | new | 5.7 | Fetal kidney | 58-48-1-F8-PU |
| ID1393 | new | 5.7 | Fetal kidney | 58-27-4-A6-PU |
| ID1394 | new | 5.7 | Fetal kidney | 58-26-3-D1-PU |
| ID1395 | new | 5.7 | Muscle | 27-19-4-B4-PU |
| ID1396 | new | 5.6 | Fetal kidney | 58-23-3-B2-PU |
| ID1397 | new | 5.5 | Heart | 25-1-2-C1-PU |
| ID1398 | new | 5.5 | Fetal kidney | 58-14-3-F10-PU |
| ID1399 | new | 5.5 | Fetal kidney | 58-25-1-E11-PU |
| ID1400 | new | 5.5 | Muscle | 27-9-4-A10-PU |
| ID1401 | new | 5.5 | Heart | 25-4-2-D8-PU |
| ID1402 | new | 5.4 | Fetal kidney | 58-29-3-G8-PU |
| ID1403 | new | 5.4 | Fetal kidney | 58-4-4-E5-PU |
| ID1404 | new | 5.4 | Fetal kidney | 58-24-2-H2-PU |
| ID1405 | new | 5.4 | Muscle | 27-11-2-C8-PU |
| ID1406 | new | 5.4 | Fetal kidney | 58-41-2-E3-PU |
| ID1407 | new | 5.3 | Muscle | 27-22-1-G8-PU |
| ID1408 | new | 5.3 | Dystrophic muscle | 29-1-1-C9-PU |
| ID1409 | new | 5.3 | Fetal kidney | 58-22-2-A3-PU |
| ID1410 | new | 5.2 | Fetal kidney | 58-42-2-G1-PU |
| ID1411 | new | 5.2 | Fetal kidney | 58-52-2-E5-PU |
| ID1412 | new | 5.2 | Fetal kidney | 58-24-2-G2-PU |
| ID1413 | new | 5.2 | Fetal kidney | 58-29-1-A3-PU |
| ID1414 | new | 5.1 | Fetal kidney | 58-26-1-G8-PU |
| ID1415 | new | 5.1 | Fetal kidney | 58-29-4-G12-PU |
| ID1416 | new | 5.1 | Dystrophic muscle | 29-8-3-E8-PU |
| ID1417 | new | 5.1 | Dystrophic muscle | 29-3-4-C1-PU |
| ID1418 | new | 5 | Fetal kidney | 58-17-2-H1-PU |
| ID1419 | new | 5 | Fetal kidney | 58-9-3-E3-PU |
| ID1420 | new | 5 | Muscle | 27-19-3-G7-PU |
| ID1421 | new | 5 | Fetal kidney | 58-41-3-B4-PU |
| ID1422 | new | 5 | Dystrophic muscle | 29-7-4-G7-PU |
| ID1423 | new | 5 | Muscle | 27-9-3-D4-PU |
| ID1424 | new | 4.9 | Kidney | 21-3-4-C5-PU |
| ID1425 | new | 4.9 | Heart | 25-11-2-D6-PU |
| ID1426 | new | 4.9 | Heart | 67-7-2-F3-PU |
| ID1427 | new | 4.8 | Fetal kidney | 58-4-3-D3-PU |
| ID1428 | new | 4.8 | Fetal kidney | 58-49-3-B5-PU |
| ID1429 | new | 4.8 | Fetal kidney | 58-28-3-G12-PU |
| ID1430 | new | 4.7 | Fetal kidney | 58-53-1-A5-PU |
| ID1431 | new | 4.7 | Fetal kidney | 58-3-3-E10-PU |
| ID1432 | new | 4.7 | Fetal kidney | 58-8-1-G7-PU |
| ID1433 | new | 4.6 | Fetal kidney | 58-23-1-G9-PU |
| ID1434 | new | 4.6 | Fetal kidney | 58-21-1-H8-PU |
| ID1435 | new | 4.6 | Fetal kidney | 58-54-2-E10-PU |
| ID1436 | new | 4.6 | Fetal kidney | 58-46-3-E4-PU |
| ID1437 | new | 4.6 | Fetal kidney | 58-6-3-G3-PU |
| ID1438 | new | 4.6 | Fetal kidney | 58-41-2-B5-PU |
| ID1439 | new | 4.6 | Dystrophic muscle | 29-7-3-F2-PU |
| ID1440 | new | 4.5 | Fetal kidney | 58-2-4-G12-PU |
| ID1441 | new | 4.5 | Fetal kidney | 58-11-2-G8-PU |
| ID1442 | new | 4.4 | Fetal kidney | 58-17-1-C4-PU |
| ID1443 | new | 4.4 | Fetal kidney | 58-46-1-G7-PU |
| ID1444 | new | 4.4 | Heart | 67-3-2-F4-PU |
| ID1445 | new | 4.4 | Fetal kidney | 58-8-4-E12-PU |
| ID1446 | new | 4.4 | Fetal kidney | 58-4-2-D9-PU |
| ID1447 | new | 4.4 | Fetal kidney | 58-25-1-B5-PU |
| ID1448 | new | 4.4 | Fetal kidney | 58-15-1-C10-PU |
| ID1449 | new | 4.3 | Dystrophic muscle | 29-4-4-A10-PU |
| ID1450 | new | 4.3 | Fetal kidney | 58-32-3-H7-PU |
| ID1451 | new | 4.3 | Kidney | 21-4-4-D12-PU |
| ID1452 | new | 4.3 | Fetal kidney | 58-45-4-G9-PU |
| ID1453 | new | 4.3 | Fetal kidney | 58-1-2-E2-PU |
| ID1454 | new | 4.2 | Fetal kidney | 58-25-4-E6-PU |
| ID1455 | new | 4.2 | Fetal kidney | 58-36-4-C6-PU |
| ID1456 | new | 4.2 | Dystrophic muscle | 29-9-3-D5-PU |
| ID1457 | new | 4.2 | Fetal kidney | 58-3-3-B8-PU |
| ID1458 | new | 4.2 | Heart | 25-4-4-B4-PU |
| ID1459 | new | 4.2 | Kidney | 21-10-3-A3-PU |
| ID1460 | new | 4.2 | Muscle | 27-19-4-B5-PU |
| ID1461 | new | 4.2 | Fetal kidney | 58-23-3-D10-PU |
| ID1462 | new | 4.1 | Fetal kidney | 58-41-1-F8-PU |
| ID1463 | new | 4.1 | Heart | 25-7-2-B1-PU |

TABLE II-continued

| SEQ. ID NO. | CATEGORY | VON HEIJNE SCORE | TISSUE SOURCE | INTERNAL DESIGNATION |
|---|---|---|---|---|
| ID1464 | new | 4.1 | Fetal kidney | 58-53-3-G4-PU |
| ID1465 | new | 4.1 | Fetal kidney | 58-52-2-C2-PU |
| ID1466 | new | 4 | Muscle | 27-21-4-E12-PU |
| ID1467 | new | 4 | Fetal kidney | 58-22-2-B8-PU |
| ID1468 | new | 4 | Fetal kidney | 58-9-3-A8-PU |
| ID1469 | new | 4 | Muscle | 27-5-4-C10-PU |
| ID1470 | new | 4 | Fetal kidney | 58-38-1-G5-PU |
| ID1471 | new | 4 | Fetal kidney | 58-34-4-F6-PU |
| ID1472 | new | 4 | Heart | 25-1-4-D2-PU |
| ID1473 | new | 4 | Fetal kidney | 58-48-2-D6-PU |
| ID1474 | new | 3.9 | Fetal kidney | 58-9-3-C10-PU |
| ID1475 | new | 3.9 | Fetal kidney | 58-9-4-F2-PU |
| ID1476 | new | 3.9 | Fetal kidney | 58-32-3-G3-PU |
| ID1477 | new | 3.9 | Fetal kidney | 58-52-1-F6-PU |
| ID1478 | new | 3.9 | Fetal kidney | 58-29-1-E1-PU |
| ID1479 | new | 3.9 | Muscle | 27-3-4-A3-PU |
| ID1480 | new | 3.9 | Muscle | 27-16-3-H2-PU |
| ID1481 | new | 3.9 | Fetal kidney | 58-1-3-E1-PU |
| ID1482 | new | 3.8 | Kidney | 21-5-4-F10-PU |
| ID1483 | new | 3.8 | Kidney | 21-1-3-C9-PU |
| ID1484 | new | 3.8 | Fetal kidney | 58-1-2-C7-PU |
| ID1485 | new | 3.8 | Fetal kidney | 58-10-3-B6-PU |
| ID1486 | new | 3.8 | Fetal kidney | 58-11-4-C8-PU |
| ID1487 | new | 3.8 | Heart | 67-6-4-B12-PU |
| ID1488 | new | 3.8 | Fetal kidney | 58-7-3-B5-PU |
| ID1489 | new | 3.8 | Fetal kidney | 58-46-3-C6-PU |
| ID1490 | new | 3.7 | Dystrophic muscle | 29-2-4-D8-PU |
| ID1491 | new | 3.7 | Fetal kidney | 58-7-1-D10-PU |
| ID1492 | new | 3.7 | Kidney | 21-2-4-A11-PU |
| ID1493 | new | 3.6 | Fetal kidney | 58-45-3-B7-PU |
| ID1494 | new | 3.6 | Fetal kidney | 58-29-1-D7-PU |
| ID1495 | new | 3.6 | Fetal kidney | 58-16-3-B3-PU |
| ID1496 | new | 3.6 | Dystrophic muscle | 29-7-3-C3-PU |
| ID1497 | new | 3.6 | Fetal kidney | 58-42-3-C2-PU |
| ID1498 | new | 3.5 | Fetal kidney | 58-38-3-G8-PU |
| ID1499 | new | 3.5 | Dystrophic muscle | 29-6-2-B12-PU |
| ID1500 | new | 3.5 | Fetal kidney | 58-8-1-D1-PU |
| ID1501 | new | 3.5 | Fetal kidney | 58-24-1-H2-PU |
| ID1502 | new | 3.5 | Fetal kidney | 58-41-4-G9-PU |
| ID1503 | ext-est-not-vrt | 12.7 | Muscle | 27-22-3-H1-PU |
| ID1504 | ext-est-not-vrt | 10.5 | Fetal kidney | 58-29-1-F11-PU |
| ID1505 | ext-est-not-vrt | 8 | Fetal kidney | 58-14-2-B12-PU |
| ID1506 | ext-est-not-vrt | 7.7 | Fetal kidney | 58-5-1-C4-PU |
| ID1507 | ext-est-not-vrt | 7.1 | Fetal kidney | 58-37-4-C7-PU |
| ID1508 | ext-est-not-vrt | 6.7 | Muscle | 27-21-2-C8-PU |
| ID1509 | ext-est-not-vrt | 6.7 | Heart | 67-1-1-C8-PU |
| ID1510 | ext-est-not-vrt | 6.3 | Fetal kidney | 58-26-3-G6-PU |
| ID1511 | ext-est-not-vrt | 6.2 | Fetal kidney | 58-15-3-B12-PU |
| ID1512 | ext-est-not-vrt | 6 | Muscle | 27-5-2-G11-PU |
| ID1513 | ext-est-not-vrt | 6 | Fetal kidney | 58-8-1-H10-PU |
| ID1514 | ext-est-not-vrt | 5.8 | Fetal kidney | 58-38-4-D2-PU |
| ID1515 | ext-est-not-vrt | 5.6 | Fetal kidney | 58-53-2-E6-PU |
| ID1516 | ext-est-not-vrt | 5.6 | Fetal kidney | 58-52-2-C7-PU |
| ID1517 | ext-est-not-vrt | 5.5 | Fetal kidney | 58-34-2-E7-PU |
| ID1518 | ext-est-not-vrt | 5.4 | Fetal kidney | 58-4-1-A2-PU |
| ID1519 | ext-est-not-vrt | 5.2 | Fetal kidney | 58-11-1-D3-PU |
| ID1520 | ext-est-not-vrt | 5.2 | Fetal kidney | 58-34-3-C9-PU |
| ID1521 | ext-est-not-vrt | 5.2 | Fetal kidney | 58-35-4-H11-PU |
| ID1522 | ext-est-not-vrt | 4.6 | Fetal kidney | 58-3-4-H7-PU |
| ID1523 | ext-est-not-vrt | 4.5 | Fetal kidney | 58-25-1-F3-PU |
| ID1524 | ext-est-not-vrt | 4.5 | Fetal kidney | 58-4-4-A8-PU |
| ID1525 | ext-est-not-vrt | 4.4 | Fetal kidney | 58-11-1-C1-PU |
| ID1526 | ext-est-not-vrt | 3.9 | Muscle | 27-19-2-F5-PU |
| ID1527 | ext-est-not-vrt | 3.5 | Dystrophic muscle | 29-2-2-A2-PU |
| ID1528 | est-not-ext | 14.1 | Fetal kidney | 58-29-2-B9-PU |
| ID1529 | est-not-ext | 11.4 | Dystrophic muscle | 29-11-2-E4-PU |
| ID1530 | est-not-ext | 11.2 | Fetal kidney | 58-7-2-A7-PU |
| ID1531 | est-not-ext | 10.8 | Muscle | 27-22-3-G4-PU |
| ID1532 | est-not-ext | 9.9 | Fetal kidney | 58-9-1-G1-PU |
| ID1533 | est-not-ext | 9.7 | Dystrophic muscle | 29-8-1-H5-PU |
| ID1534 | est-not-ext | 9.6 | Fetal kidney | 58-40-1-F5-PU |
| ID1535 | est-not-ext | 9.5 | Fetal kidney | 58-6-4-G2-PU |
| ID1536 | est-not-ext | 9.2 | Fetal kidney | 58-25-2-E7-PU |
| ID1537 | est-not-ext | 8.9 | Fetal kidney | 58-48-1-A11-PU |
| ID1538 | est-not-ext | 8.8 | Fetal kidney | 58-35-2-B6-PU |
| ID1539 | est-not-ext | 8.5 | Kidney | 21-7-4-C7-PU |

TABLE II-continued

| SEQ. ID NO. | CATEGORY | VON HEIJNE SCORE | TISSUE SOURCE | INTERNAL DESIGNATION |
|---|---|---|---|---|
| ID1540 | est-not-ext | 8.4 | Fetal kidney | 58-45-1-E6-PU |
| ID1541 | est-not-ext | 8.1 | Fetal kidney | 58-39-1-A12-PU |
| ID1542 | est-not-ext | 8 | Fetal kidney | 58-46-1-C7-PU |
| ID1543 | est-not-ext | 7.9 | Dystrophic muscle | 29-12-3-E10-PU |
| ID1544 | est-not-ext | 7.9 | Fetal kidney | 58-17-2-D9-PU |
| ID1545 | est-not-ext | 7.9 | Fetal kidney | 58-52-3-B7-PU |
| ID1546 | est-not-ext | 7.6 | Fetal kidney | 58-24-3-E7-PU |
| ID1547 | est-not-ext | 7.6 | Heart | 25-8-4-B12-PU |
| ID1548 | est-not-ext | 7.6 | Dystrophic muscle | 29-4-4-D12-PU |
| ID1549 | est-not-ext | 7.4 | Muscle | 27-1-2-B3-PU |
| ID1550 | est-not-ext | 7.3 | Fetal kidney | 58-48-1-G3-PU |
| ID1551 | est-not-ext | 7.3 | Dystrophic muscle | 29-2-3-F8-PU |
| ID1552 | est-not-ext | 7.2 | Fetal kidney | 58-19-3-B3-PU |
| ID1553 | est-not-ext | 7 | Fetal kidney | 58-14-2-C4-PU |
| ID1554 | est-not-ext | 6.7 | Fetal kidney | 58-16-3-B6-PU |
| ID1555 | est-not-ext | 6.6 | Fetal kidney | 58-9-4-F6-PU |
| ID1556 | est-not-ext | 6.4 | Fetal kidney | 58-1-1-E3-PU |
| ID1557 | est-not-ext | 6.4 | Fetal kidney | 58-33-3-B4-PU |
| ID1558 | est-not-ext | 6.3 | Dystrophic muscle | 29-12-1-H1-PU |
| ID1559 | est-not-ext | 6.3 | Muscle | 27-9-3-A5-PU |
| ID1560 | est-not-ext | 6.2 | Muscle | 27-17-4-C12-PU |
| ID1561 | est-not-ext | 6.2 | Fetal kidney | 58-33-1-F1-PU |
| ID1562 | est-not-ext | 5.9 | Fetal kidney | 58-48-4-H2-PU |
| ID1563 | est-not-ext | 5.9 | Fetal kidney | 58-42-1-A6-PU |
| ID1564 | est-not-ext | 5.7 | Fetal kidney | 58-33-4-E1-PU |
| ID1565 | est-not-ext | 5.7 | Fetal kidney | 58-26-2-E12-PU |
| ID1566 | est-not-ext | 5.6 | Fetal kidney | 58-26-1-E12-PU |
| ID1567 | est-not-ext | 5.5 | Fetal kidney | 58-54-1-D11-PU |
| ID1568 | est-not-ext | 5.5 | Muscle | 27-9-2-F9-PU |
| ID1569 | est-not-ext | 5.4 | Fetal kidney | 58-30-2-H10-PU |
| ID1570 | est-not-ext | 5.3 | Fetal kidney | 58-29-1-H1-PU |
| ID1571 | est-not-ext | 5.3 | Kidney | 21-1-4-F2-PU |
| ID1572 | est-not-ext | 5.1 | Fetal kidney | 58-42-4-H7-PU |
| ID1573 | est-not-ext | 5 | Fetal kidney | 58-34-3-H10-PU |
| ID1574 | est-not-ext | 5 | Kidney | 21-7-3-B4-PU |
| ID1575 | est-not-ext | 4.9 | Fetal kidney | 58-4-2-D12-PU |
| ID1576 | est-not-ext | 4.8 | Fetal kidney | 58-31-2-C10-PU |
| ID1577 | est-not-ext | 4.7 | Fetal kidney | 58-37-3-C10-PU |
| ID1578 | est-not-ext | 4.7 | Fetal kidney | 58-1-1-D11-PU |
| ID1579 | est-not-ext | 4.6 | Fetal kidney | 58-52-1-A11-PU |
| ID1580 | est-not-ext | 4.3 | Fetal kidney | 58-4-3-E10-PU |
| ID1581 | est-not-ext | 4.3 | Heart | 67-6-4-F2-PU |
| ID1582 | est-not-ext | 4.2 | Fetal kidney | 58-49-3-G10-PU |
| ID1583 | est-not-ext | 4.1 | Dystrophic muscle | 29-10-3-B11-PU |
| ID1584 | est-not-ext | 4.1 | Heart | 25-5-4-A7-PU |
| ID1585 | est-not-ext | 4.1 | Fetal kidney | 58-33-2-C6-PU |
| ID1586 | est-not-ext | 4 | Heart | 25-7-3-D4-PU |
| ID1587 | est-not-ext | 3.9 | Heart | 67-1-3-B11-PU |
| ID1588 | est-not-ext | 3.9 | Fetal kidney | 58-23-1-G5-PU |
| ID1589 | est-not-ext | 3.7 | Fetal kidney | 58-6-1-B6-PU |
| ID1590 | est-not-ext | 3.7 | Dystrophic muscle | 29-6-2-H8-PU |
| ID1591 | est-not-ext | 3.7 | Fetal kidney | 58-43-4-B8-PU |
| ID1592 | est-not-ext | 3.6 | Muscle | 27-3-4-G9-PU |
| ID1593 | est-not-ext | 3.6 | Fetal kidney | 58-38-1-F10-PU |
| ID1594 | est-not-ext | 3.5 | Heart | 67-6-4-E7-PU |
| ID1595 | est-not-ext | 3.5 | Fetal kidney | 58-54-1-E6-PU |
| ID1596 | est-not-ext | 3.5 | Heart | 67-4-4-G7-PU |
| ID1597 | est-not-ext | 3.5 | Fetal kidney | 58-23-4-F4-PU |
| ID1598 | ext-vrt-not-genomic | 10.5 | Fetal kidney | 58-42-3-A12-PU |
| ID1599 | new | 14.3 | Substantia nigra | 47-39-4-A10-PU |
| ID1600 | new | 11.1 | Fetal brain | 57-9-4-C5-PU |
| ID1601 | new | 10.6 | Fetal brain | 57-19-1-B11-PU |
| ID1602 | new | 9.1 | Fetal brain | 57-7-1-G12-PU |
| ID1603 | new | 8.8 | Substantia nigra | 47-22-3-D2-PU |
| ID1604 | new | 8.7 | Fetal brain | 57-21-2-H11-PU |
| ID1605 | new | 8.4 | Substantia nigra | 47-37-3-F6-PU |
| ID1606 | new | 8.2 | Substantia nigra | 47-54-1-A8-PU |
| ID1607 | new | 8.2 | Substantia nigra | 47-15-1-E5-PU |
| ID1608 | new | 8 | Substantia nigra | 47-24-1-A6-PU |
| ID1609 | new | 7.8 | Fetal brain | 57-10-3-H10-PU |
| ID1610 | new | 7.7 | Substantia nigra | 47-17-1-D7-PU |
| ID1611 | new | 7.6 | Cerebellum | 55-9-4-A4-PU |
| ID1612 | new | 7.5 | Substantia nigra | 47-18-3-C2-PU |
| ID1613 | new | 7.4 | Fetal brain | 57-19-1-C8-PU |
| ID1614 | new | 7.4 | Substantia nigra | 47-1-4-C5-PU |
| ID1615 | new | 7.2 | Substantia nigra | 47-24-1-B5-PU |

TABLE II-continued

| SEQ. ID NO. | CATEGORY | VON HEIJNE SCORE | TISSUE SOURCE | INTERNAL DESIGNATION |
|---|---|---|---|---|
| ID1616 | new | 7.2 | Cerebellum | 55-6-2-A9-PU |
| ID1617 | new | 7.1 | Substantia nigra | 47-30-4-A8-PU |
| ID1618 | new | 6.9 | Fetal brain | 57-21-1-D5-PU |
| ID1619 | new | 6.9 | Substantia nigra | 47-4-2-C7-PU |
| ID1620 | new | 6.8 | Substantia nigra | 47-12-3-A8-PU |
| ID1621 | new | 6.8 | Substantia nigra | 47-7-4-E6-PU |
| ID1622 | new | 6.8 | Substantia nigra | 47-15-3-G3-PU |
| ID1623 | new | 6.7 | Fetal brain | 57-20-2-B5-PU |
| ID1624 | new | 6.6 | Substantia nigra | 47-2-2-E6-PU |
| ID1625 | new | 6.5 | Fetal brain | 57-25-1-G3-PU |
| ID1626 | new | 6.5 | Fetal brain | 57-7-4-B12-PU |
| ID1627 | new | 6.5 | Substantia nigra | 47-21-1-D9-PU |
| ID1628 | new | 6.4 | Substantia nigra | 47-31-2-H9-PU |
| ID1629 | new | 5.7 | Cerebellum | 55-1-3-D11-PU |
| ID1630 | new | 5.7 | Cerebellum | 55-7-2-A1-PU |
| ID1631 | new | 5.7 | Fetal brain | 57-28-3-C1-PU |
| ID1632 | new | 5.6 | Fetal brain | 57-9-4-D11-PU |
| ID1633 | new | 5.5 | Substantia nigra | 47-7-4-C10-PU |
| ID1634 | new | 5.5 | Fetal brain | 57-22-1-E11-PU |
| ID1635 | new | 5.4 | Fetal brain | 57-20-2-D9-PU |
| ID1636 | new | 5.4 | Substantia nigra | 47-39-3-E7-PU |
| ID1637 | new | 5.4 | Surrenals | 62-3-1-G5-PU |
| ID1638 | new | 5.4 | Fetal brain | 57-18-4-H5-PU |
| ID1639 | new | 5.4 | Fetal brain | 57-22-2-H8-PU |
| ID1640 | new | 5.3 | Fetal brain | 57-22-2-E12-PU |
| ID1641 | new | 5.3 | Fetal brain | 57-23-3-B8-PU |
| ID1642 | new | 5.2 | Fetal brain | 57-6-3-C5-PU |
| ID1643 | new | 5.2 | Substantia nigra | 47-7-1-D2-PU |
| ID1644 | new | 5.1 | Fetal brain | 57-7-2-G9-PU |
| ID1645 | new | 5.1 | Fetal brain | 57-10-3-D3-PU |
| ID1646 | new | 5.1 | Substantia nigra | 47-4-4-F2-PU |
| ID1647 | new | 5.1 | Fetal brain | 57-4-4-H6-PU |
| ID1648 | new | 5 | Substantia nigra | 47-10-2-G12-PU |
| ID1649 | new | 5 | Cerebellum | 55-10-3-E12-PU |
| ID1650 | new | 4.9 | Substantia nigra | 47-8-2-D1-PU |
| ID1651 | new | 4.9 | Fetal brain | 57-3-4-C9-PU |
| ID1652 | new | 4.9 | Substantia nigra | 47-14-1-C3-PU |
| ID1653 | new | 4.8 | Substantia nigra | 47-3-4-C8-PU |
| ID1654 | new | 4.8 | Substantia nigra | 47-15-1-B10-PU |
| ID1655 | new | 4.8 | Fetal brain | 57-26-3-A12-PU |
| ID1656 | new | 4.7 | Substantia nigra | 47-26-3-B10-PU |
| ID1657 | new | 4.7 | Substantia nigra | 47-26-1-B6-PU |
| ID1658 | new | 4.7 | Surrenals | 62-5-1-B8-PU |
| ID1659 | new | 4.6 | Substantia nigra | 47-15-4-H9-PU |
| ID1660 | new | 4.6 | Cerebellum | 55-2-4-D3-PU |
| ID1661 | new | 4.5 | Fetal brain | 57-6-1-B1-PU |
| ID1662 | new | 4.5 | Fetal brain | 57-26-4-E4-PU |
| ID1663 | new | 4.5 | Substantia nigra | 47-2-2-A7-PU |
| ID1664 | new | 4.5 | Substantia nigra | 47-55-2-B3-PU |
| ID1665 | new | 4.5 | Substantia nigra | 47-54-1-C9-PU |
| ID1666 | new | 4.4 | Cerebellum | 55-8-2-A2-PU |
| ID1667 | new | 4.4 | Substantia nigra | 47-4-2-H4-PU |
| ID1668 | new | 4.3 | Fetal brain | 57-27-3-B11-PU |
| ID1669 | new | 4.2 | Fetal brain | 57-22-4-D2-PU |
| ID1670 | new | 4.2 | Substantia nigra | 47-20-4-E2-PU |
| ID1671 | new | 4.2 | Substantia nigra | 47-2-3-H2-PU |
| ID1672 | new | 4.1 | Substantia nigra | 47-22-3-G5-PU |
| ID1673 | new | 4.1 | Fetal brain | 57-18-3-A5-PU |
| ID1674 | new | 4.1 | Fetal brain | 57-9-3-H7-PU |
| ID1675 | new | 4.1 | Surrenals | 62-5-2-B6-PU |
| ID1676 | new | 4 | Cerebellum | 55-12-1-E12-PU |
| ID1677 | new | 4 | Fetal brain | 57-20-1-A5-PU |
| ID1678 | new | 3.9 | Substantia nigra | 47-22-4-F6-PU |
| ID1679 | new | 3.8 | Fetal brain | 57-19-3-E1-PU |
| ID1680 | new | 3.8 | Substantia nigra | 47-18-3-G5-PU |
| ID1681 | new | 3.8 | Substantia nigra | 47-20-1-G3-PU |
| ID1682 | new | 3.8 | Fetal brain | 57-6-4-A1-PU |
| ID1683 | new | 3.8 | Fetal brain | 57-27-3-G10-PU |
| ID1684 | new | 3.7 | Substantia nigra | 47-2-4-C7-PU |

TABLE II-continued

| SEQ. ID NO. | CATEGORY | VON HEIJNE SCORE | TISSUE SOURCE | INTERNAL DESIGNATION |
| --- | --- | --- | --- | --- |
| ID1685 | new | 3.7 | Cerebellum | 55-6-1-E6-PU |
| ID1686 | new | 3.6 | Fetal brain | 57-4-4-F7-PU |
| ID1687 | new | 3.6 | Substantia nigra | 47-30-2-B1-PU |
| ID1688 | new | 3.6 | Substantia nigra | 47-29-1-F11-PU |
| ID1689 | new | 3.6 | Substantia nigra | 47-39-3-D4-PU |
| ID1690 | new | 3.5 | Substantia nigra | 47-15-2-G3-PU |
| ID1691 | new | 3.5 | Fetal brain | 57-18-3-E6-PU |
| ID1692 | new | 3.5 | Substantia nigra | 47-40-2-G6-PU |
| ID1693 | new | 3.5 | Fetal brain | 57-6-4-D7-PU |
| ID1694 | new | 3.5 | Substantia nigra | 47-55-4-A8-PU |
| ID1695 | ext-est-not-vrt | 9.8 | Substantia nigra | 47-39-4-B9-PU |
| ID1696 | ext-est-not-vrt | 9.2 | Cerebellum | 55-11-1-H5-PU |
| ID1697 | ext-est-not-vrt | 9 | Substantia nigra | 47-4-4-G1-PU |
| ID1698 | ext-est-not-vrt | 7.2 | Substantia nigra | 47-2-3-G9-PU |
| ID1699 | ext-est-not-vrt | 7.2 | Cerebellum | 55-10-3-F5-PU |
| ID1700 | ext-est-not-vrt | 5.6 | Fetal brain | 57-4-4-G6-PU |
| ID1701 | ext-est-not-vrt | 4.2 | Cerebellum | 55-7-1-D11-PU |
| ID1702 | ext-est-not-vrt | 3.7 | Substantia nigra | 47-19-2-F7-PU |
| ID1703 | ext-est-not-vrt | 3.7 | Substantia nigra | 47-1-4-D2-PU |
| ID1704 | ext-est-not-vrt | 3.6 | Cerebellum | 55-5-4-A6-PU |
| ID1705 | ext-est-not-vrt | 3.6 | Cerebellum | 55-4-4-H3-PU |
| ID1706 | ext-est-not-vrt | 3.5 | Cerebellum | 55-3-1-G6-PU |
| ID1707 | ext-est-not-vrt | 3.5 | Substantia nigra | 47-55-2-H2-PU |
| ID1708 | est-not-ext | 12.4 | Substantia nigra | 47-39-4-H8-PU |
| ID1709 | est-not-ext | 11.4 | Fetal brain | 57-26-4-A4-PU |
| ID1710 | est-not-ext | 11.1 | Substantia nigra | 47-2-3-D1-PU |
| ID1711 | est-not-ext | 9.2 | Substantia nigra | 47-4-1-E4-PU |
| ID1712 | est-not-ext | 9 | Substantia nigra | 47-40-4-G9-PU |
| ID1713 | est-not-ext | 8.8 | Fetal brain | 57-5-4-G3-PU |
| ID1714 | est-not-ext | 7.5 | Substantia nigra | 47-13-4-C1-PU |
| ID1715 | est-not-ext | 7.4 | Fetal brain | 57-20-4-E2-PU |
| ID1716 | est-not-ext | 7 | Substantia nigra | 47-24-4-H4-PU |
| ID1717 | est-not-ext | 6.9 | Substantia nigra | 47-26-2-B2-PU |
| ID1718 | est-not-ext | 6.8 | Substantia nigra | 47-11-1-A2-PU |
| ID1719 | est-not-ext | 6.4 | Fetal brain | 57-19-2-G8-PU |
| ID1720 | est-not-ext | 6.4 | Fetal brain | 57-19-4-H8-PU |
| ID1721 | est-not-ext | 6.3 | Substantia nigra | 47-39-2-A11-PU |
| ID1722 | est-not-ext | 6.2 | Fetal brain | 57-24-2-B4-PU |
| ID1723 | est-not-ext | 5.9 | Surrenals | 62-1-1-G3-PU |
| ID1724 | est-not-ext | 5.7 | Fetal brain | 57-2-4-H4-PU |
| ID1725 | est-not-ext | 5.6 | Fetal brain | 57-8-2-D3-PU |
| ID1726 | est-not-ext | 5.5 | Cerebellum | 55-11-4-G2-PU |
| ID1727 | est-not-ext | 5.4 | Substantia nigra | 47-24-1-B6-PU |
| ID1728 | est-not-ext | 5.4 | Substantia nigra | 47-55-3-B10-PU |
| ID1729 | est-not-ext | 5.4 | Surrenals | 62-8-1-B12-PU |
| ID1730 | est-not-ext | 5.3 | Substantia nigra | 47-39-1-C9-PU |
| ID1731 | est-not-ext | 5.3 | Fetal brain | 57-20-2-F1-PU |
| ID1732 | est-not-ext | 5.2 | Fetal brain | 57-25-1-F10-PU |
| ID1733 | est-not-ext | 5.2 | Fetal brain | 57-28-4-B12-PU |
| ID1734 | est-not-ext | 5.1 | Substantia nigra | 47-15-2-D12-PU |
| ID1735 | est-not-ext | 5.1 | Substantia nigra | 47-2-3-G3-PU |
| ID1736 | est-not-ext | 4.9 | Substantia nigra | 47-40-3-D8-PU |
| ID1737 | est-not-ext | 4.9 | Substantia nigra | 47-40-3-G11-PU |
| ID1738 | est-not-ext | 4.9 | Substantia nigra | 47-14-3-D2-PU |
| ID1739 | est-not-ext | 4.8 | Substantia nigra | 47-19-1-B7-PU |
| ID1740 | est-not-ext | 4.8 | Substantia nigra | 47-19-1-A3-PU |
| ID1741 | est-not-ext | 4.7 | Substantia nigra | 47-55-3-G2-PU |
| ID1742 | est-not-ext | 4.6 | Substantia nigra | 47-3-4-G7-PU |
| ID1743 | est-not-ext | 4.5 | Substantia nigra | 47-29-1-B7-PU |
| ID1744 | est-not-ext | 4.4 | Fetal brain | 57-21-4-G6-PU |
| ID1745 | est-not-ext | 4.3 | Substantia nigra | 47-2-1-E12-PU |
| ID1746 | est-not-ext | 4.3 | Substantia nigra | 47-9-4-D2-PU |
| ID1747 | est-not-ext | 4.3 | Fetal brain | 57-2-4-F8-PU |
| ID1748 | est-not-ext | 4.3 | Fetal brain | 57-18-1-D5-PU |
| ID1749 | est-not-ext | 4.2 | Substantia nigra | 47-8-4-D2-PU |
| ID1750 | est-not-ext | 4.1 | Substantia nigra | 47-17-3-H11-PU |
| ID1751 | est-not-ext | 3.9 | Fetal brain | 57-28-2-G6-PU |
| ID1752 | est-not-ext | 3.7 | Fetal brain | 57-27-3-G1-PU |
| ID1753 | est-not-ext | 3.7 | Substantia nigra | 47-37-4-G11-PU |
| ID1754 | est-not-ext | 3.7 | Surrenals | 62-11-3-A2-PU |
| ID1755 | ext-vrt-not-genomic | 10.9 | Surrenals | 62-10-2-E4-PU |
| ID1756 | ext-vrt-not-genomic | 8.9 | Substantia nigra | 47-14-3-H7-PU |

TABLE III

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID38 | MLLLLGLCLGLSLC | 1757 | -14 through -1 |
| ID39 | MENGGAGTLQIRQVLLFVLLGMSQA | 1758 | -26 through -1 |
| ID40 | MRGPEPGPGPQPTMEGDVLDTLEALGYKGPLLEEQALTKAAEGGLSSPEFSELCIWLGSQIKSLCNLEESITSAGRDDLESFQLEISGFLKEMACPYSVLISGDIKDRLKKKED CLKLLLFLSTELQA | 1759 | -126 through -1 |
| ID41 | MEKSWMLWNFVERWLIALASWSWALC | 1760 | -26 through -1 |
| ID42 | MQQTRTEAVAGAFSHCLGFCGMRLGLLLLARHWCIA | 1761 | -36 through -1 |
| ID43 | MEKGNAFLKNRLVVFLLLPLASGP | 1762 | -24 through -1 |
| ID44 | MFPFNQAGLPTLLMLIVFHAASMA | 1763 | -24 through -1 |
| ID45 | MTSRSLRRCCSCLRVTHNKEILASTVSLGVEGYMLGGGSRINSSNLNDGBEECSPDSLLVWKKKSLLLWMSSLPSLG | 1764 | -76 through -1 |
| ID46 | MWTASAMDFRTCIASXLPALCYVQACRALMIAASVLGLPAILLLTVLPCIXM | 1765 | -53 through -1 |
| ID47 | MGPPPTHIKYLHLNIYCNGKSTAPGIRSHSLGFALLSLSHPTCQA | 1766 | -45 through -1 |
| ID48 | MFCLLTFLAFTLLFA | 1767 | -16 through -1 |
| ID49 | MHCGSTPGLCPCWVPFLKCLLAVLSSLFA | 1768 | -29 through -1 |
| ID50 | MNLVCSALLLLGIVSS | 1769 | -16 through -1 |
| ID51 | MSVLDDRQRDILVVQKRHSSLEAAMLIGLLAWLQT | 1770 | -35 through -1 |
| ID52 | MGVNGRRLLIICHYLPLSLC | 1771 | -20 through -1 |
| ID53 | MKLRECPALRWSQLSQHKLECLLLYLAESSG | 1772 | -31 through -1 |
| ID54 | MDPRGILKAFPKRQKIHADASSKVLAKIPRREBGEAEEWLSSLRAHVRTGIRARAELFEKQIVQHGGQLCPAQGPVTHIVVDEGMDYERALRLRLPQLPPXCSA | 1773 | -109 through -1 |
| ID55 | MFWKLSLSLFLVAVLVKVAEA | 1774 | -21 through -1 |
| ID56 | MAFLGLFSLLVLQSMATG | 1775 | -18 through -1 |
| ID57 | MAFLGLFSLLVLQSMATG | 1776 | -18 through -1 |
| ID58 | MSFSLNFTLPANTTSSPVTGGKETDCGPSLGLAAGIPLLVATALLVALLFTLIHR | 1777 | -55 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID59 | MSTWYLALNKSYKNKDSVRIYLSLCTVSIKFYTYFHDIQTNCLTTWKHSRCRFYWAFGGSILQHSVDPLVLFLSLALLVTP | 1778 | -80 through -1 |
| ID60 | MAIGISLQLLCCIFTLVLQ | 1779 | -19 through -1 |
| ID61 | MQATSNLLNLLLSLFAGL | 1780 | -19 through -1 |
| ID62 | MMKWKPEDLGSVPCEAFSVTLLCGWPGSHWC | 1781 | -31 through -1 |
| ID63 | MQATSNLLNLLLSLFAGL | 1782 | -19 through -1 |
| ID64 | MASSHWNETTSVVQYLGFQVQKIYPFHDNWNTACFVILLLFIFTVVS | 1783 | -48 through -1 |
| ID65 | MLWFSGVGALAERYCRRSPGITCCVLLLNCSG | 1784 | -33 through -1 |
| ID66 | MLFLQMGKQSWTLIFFLNVTQLVRG | 1785 | -25 through -1 |
| ID67 | MELRXXPPGGREVQLLLGLCSPXXSL | 1786 | -27 through -1 |
| ID68 | MLWSLLSSSGSHFG | 1787 | -14 through -2 |
| ID69 | MDISGLIPGLVSTFILLSXSDHYGRKFPMILSSVGALATSVWLCLLCYFAFP | 1788 | -52 through -1 |
| ID70 | MXVFFSKNRFEMYFSLLLFVILLITSLIFC | 1789 | -30 through -1 |
| ID71 | MPVPACWISSSLSLLASHHSVSC | 1790 | -23 through -1 |
| ID72 | MCPVFSKQLLACGSLLPGLWQ | 1791 | -21 through -1 |
| ID73 | MALTIHGERMRPDWESPWITSSQAQSLSLGGSPSSRGPLVPRGEYLASCPEGVRSHSLLPRSLLPLSAWPPWAWH | 1792 | -76 through -1 |
| ID74 | MAARFRCGHLCVPEVPRGPASHAEGGGGRLSRKAAHQOLCWRAGGDGRGNFNPMNFLVAGTFASSCHSPPLLWSLPRILIASSLPTLSHP | 1793 | -92 through -1 |
| ID75 | MASTISAYKEKMKELSVLSLICSCFYTQP | 1794 | -29 through -1 |
| ID76 | MLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQS | 1795 | -114 through -1 |
| ID77 | MSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSA | 1796 | -118 through -1 |
| ID78 | MCKGIKAGDTCEKLVGYSAVYRVCFGMACFFFIFCLLTLKINNSKSCRAHIHNGFWFKLLLLGAMCSG | 1797 | -69 through -1 |
| ID79 | MSDSAGGRAGLRRYPKLPVWVVEDHQEVLPFIYRAIGSKELPASNVSFLHFDSHPDLLIPVNMPADTVFDKETLFGELSIENWIMPAVYAGHFSHVVWFHPTWA | 1798 | -104 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID80 | MSSCRGQKVAGGLRVVSPFPLCQPAGEPSRGKMRSSCVLLTAIVALA | 1799 | -47 through -1 |
| ID81 | MIIPFKIKNLGGRVLLSGREMPPASVRAPDLAVALSLLPAWT | 1800 | -42 through -1 |
| ID82 | MVCSAPRKIVVRAFITIIFIYYAIKKRANEPAAYLMLKPEALILLLLAQKGPS | 1801 | -53 through -1 |
| ID83 | MTESSMKKLASTLLDAITDKDPLVQEQVCSALCSLGEVRP | 1802 | -40 through -1 |
| ID84 | MQETDCNKRWGRGLGGLWSETGRRFHCKSFVFLFHCTSGLSSC | 1803 | -43 through -2 |
| ID85 | MLLEVPWLSSTVSCAQG | 1804 | -17 through -1 |
| ID86 | MSGGRMQARCSQQSTWSPAFLAVAGPGWA | 1805 | -29 through -1 |
| ID87 | MLQMLWHFLASFFPRAGC | 1806 | -18 through -1 |
| ID88 | MYSHPVSSLVCLLAMGKGLG | 1807 | -20 through -1 |
| ID89 | MGRKEEDCSXWKKQTTNIRKTFIFMEVLGSGAFS | 1808 | -35 through -1 |
| ID90 | MMIAVFGNANDRNVLTLLPNQSLFSLARA | 1809 | -29 through -1 |
| ID91 | MFFELPLVVTAWFFGMCRS | 1810 | -19 through -1 |
| ID92 | MNHNIIICVMYIVPFLMTKCLIFCHSCKRGSFLLIVANVHFSQT | 1811 | -44 through -1 |
| ID93 | MSCGSAASLTGLCXCCLQALG | 1812 | -21 through -1 |
| ID94 | MQAVDNLTSAPGNTSLCTRDYKITQVLFPLLYTVLFFVGLIINGLA | 1813 | -46 through -1 |
| ID95 | MAAAMXLLCSSCCSWGPAAG | 1814 | -20 through -1 |
| ID96 | MDFIKDQSLSHRSVVKVLSLRKAQA | 1815 | -25 through -1 |
| ID97 | MTRPFWASCSTWATSRISCAFSLASSTA | 1816 | -28 through -1 |
| ID98 | MKSCAVSLTTAAVAFG | 1817 | -16 through -1 |
| ID99 | MSIHECACLSLSLICLRMSLS | 1818 | -21 through -1 |
| ID100 | MLSGLSFLSVFSLWC | 1819 | -15 through -1 |
| ID101 | MGLKDKSQAPASGLGVLRGQRSGSFISMPAPASGQXPEESRSPAPPVASRSQNRGYRPWHGPLWVHQSVRFGLYSILHFPFWVHG | 1820 | -85 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID102 | MSDQIKFIMDSLNKEPFRKNYNLITFDSLEPMQLLQVLSDVLA | 1821 | -43 through -1 |
| ID103 | MSPSCLHPDLWSMCLEVPSFTATDSVNCGCCLELATEPARNIRSTTRASLLRCSSFTSTRNSTGISALPPAAPMAWPSASLSTLPVPLTHSSVASLTATPSLA | 1822 | -104 through -1 |
| ID104 | MDLSFHLLLDPSSTQS | 1823 | -16 through -1 |
| ID105 | MPHFLDWFVXVYLIVISVLILVGFGAC | 1824 | -26 through -1 |
| ID106 | MSKLKVIPEKSLTNNSRIVGLLAQLEKINA | 1825 | -30 through -1 |
| ID107 | MMSASRLAGTLIPAMAFLSCVRP | 1826 | -23 through -1 |
| ID108 | MVDGTQLRGLTRMYQVPLXLDRDETLVRLRFTMVALVTVCCXLVAPLFC | 1827 | -49 through -1 |
| ID109 | MKQNFLVLNSVWYLISMLQMLAVIIT | 1828 | -26 through -1 |
| ID110 | MECQNSSLKKCLLVEKSLVKASYLIAPQTAASKKPFSIAEELIKPYLIVEMCLEVLGSSA | 1829 | -59 through -2 |
| ID111 | MHSSIKTKGSVMNLVALLEMCVC | 1830 | -23 through -1 |
| ID112 | MTVLPLEAISSLSSFVLG | 1831 | -18 through -1 |
| ID113 | MGTASRSNIARHLQTNLILFCVGAVGACTL | 1832 | -30 through -1 |
| ID114 | MNSSKEEMRELAALFYSVVVSTVSG | 1833 | -25 through -1 |
| ID115 | MSQDGGXGELKHMVMSFRVSELQVLLGFAGRNKSGRKHELLAKALHLLKSSC | 1834 | -52 through -1 |
| ID116 | MPCISLLGLLYNFVQVLCYLSIFCLGVLF | 1835 | -29 through -1 |
| ID117 | MKIAVLFCFFLLIF | 1836 | -15 through -1 |
| ID118 | MAKQKPHVLGSRVMPASCVSERRRKPSFQVSTWSSASLRGSWQ | 1837 | -43 through -1 |
| ID119 | MGFLYLKSVFDVSLG | 1838 | -15 through -1 |
| ID120 | MRMGPGRKRDFSPVPWSQYFESMEDVEVENETGKDTFRVYKSGSEGPVLLLHGGGHSALS | 1839 | -61 through -1 |
| ID121 | MIFLLYLLPSSEE | 1840 | -13 through -1 |
| ID122 | MRMGPGRKRDFSPVPWSQYFESMEDVEVENETGKDTFRVYKSGSEGPVLLLHGGGHSALS | 1841 | -61 through -1 |
| ID123 | MLSLLNLISILASIPS | 1842 | -16 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID124 | MGTTSNMVTTIHLMLLWPVHPLLVG | 1843 | -25 through -1 |
| ID125 | MGDPERPEAAGLDQDERSSSDTNESEIKSNEEPLLRKSSRRFVIFPIQYPDIWKMYKQAQASFWTAEEVDLSKDLPHWNKLKADEKYFISHILAFFAASDG | 1844 | -101 through -1 |
| ID126 | MDAGLFSLLPHPPCVG | 1845 | -16 through -1 |
| ID127 | MLITLTYLIQGESA | 1846 | -14 through -1 |
| ID128 | MYTGFRIEATLLTRVQCLCAIPFAFS | 1847 | -26 through -1 |
| ID129 | MYKQAQASFWTAEEVDLSKDLPHWNKLKADEKYFISHILAFFAASDG | 1848 | -47 through -1 |
| ID130 | MLIHLCSVKNLYQNRFLGLAAMASPSRN | 1849 | -28 through -1 |
| ID131 | MPCPTWTCLKSFPSPTSS | 1850 | -18 through -1 |
| ID132 | MEDLFSPSIXPPAPNISVPILLGWGLNLTLGQG | 1851 | -33 through -1 |
| ID133 | MAETKDAAQMLVTFKDVAVTFTREEWRQLDLAQRTLYREVMLETCGLLVSLG | 1852 | -52 through -1 |
| ID134 | MLILSQNIAQLEA | 1853 | -13 through -1 |
| ID135 | MLLGASAQGLWAHSWTCSCSA | 1854 | -21 through -1 |
| ID136 | MAAPLELSCWGGGWG | 1855 | -15 through -1 |
| ID137 | MSXVGIDLGFLNCYIAVARS | 1856 | -20 through -1 |
| ID138 | MEYSKXFVVFSTMFTASSP | 1857 | -19 through -1 |
| ID139 | MPMASSPPPSPHPQEPAPLLPSLPRLSLPFRLPWASTATA | 1858 | -40 through -1 |
| ID140 | MQHVXGHXPDPIAIMYVCPPCGHTTWALGLKFLSSSSQ | 1859 | -38 through -1 |
| ID141 | MGWEMTCIKSFFWARSHAGFLKCLLLSSLQ | 1860 | -30 through -1 |
| ID142 | MVFGGVCPSVTSIIAESLQGWNLVQLSFAATTPVLA | 1861 | -36 through -1 |
| ID143 | MHFITWSLLFLYQCSL | 1862 | -16 through -1 |
| ID144 | MSGASPIERTPMEEAPSSCPTSSCWPSVASPSSSWS | 1863 | -36 through -1 |
| ID145 | MEWAGKQRDFQVRAAPGWDHLASFPGPSLRLFSGSQA | 1864 | -37 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID146 | MIAFFDEDNPRKRRSYSFTQSAGILCQETTYSTPHTKLEKAKSPTADAKVVSLSLQTSSA | 1865 | -60 through -1 |
| ID147 | MGKSIXSLCSVXLKARLKGXLEAVHLCLRAQKRTALFCTLPCPVERG | 1866 | -48 through -1 |
| ID148 | MCLHMTLFRVPFTFS | 1867 | -15 through -1 |
| ID149 | MLNILKTLTSAALP | 1868 | -14 through -1 |
| ID150 | MRARVWPRSHGIPVPSFLSKSSLSHTPSPLLCLYHPVYT | 1869 | -40 through -1 |
| ID151 | MWNAVAIICNGSWCQTXSTSGLESLCLSLLIPGPKP | 1870 | -36 through -1 |
| ID152 | MRLGLFKISWARC | 1871 | -14 through -1 |
| ID153 | MPFAEDKTYKYICRNFSNFCNVDVVEILPYLPCLTA | 1872 | -36 through -1 |
| ID154 | MPGSSGLRFICKSRNHPQFGSFSGTDSLSFLPCPC | 1873 | -36 through -1 |
| ID155 | MDVTGDEEEIKQEINMLKKYSHHRNIATYYGAFIKNPPGMDDQLXLVMEFCGAGS | 1874 | -57 through -1 |
| ID156 | MIFGLYFVLAVKLFLVFLLNICKG | 1875 | -24 through -1 |
| ID157 | MRKKRVEELIVFPGEVTSFSSIKCSSWISSLASG | 1876 | -34 through -1 |
| ID158 | MPSSSLAELCLMQQDACLFSXFLAVSRH | 1877 | -28 through -1 |
| ID159 | MDLWSCLFPVMLMEPSKGLEDSEWKMALQMRNQLPCLVLG | 1878 | -40 through -1 |
| ID160 | MSGKGKCRPIALRRAVPLPTTSTLTSA | 1879 | -27 through -1 |
| ID161 | MTPKAIQKSSGLFCPSQA | 1880 | -18 through -1 |
| ID162 | MPDQFDQAVVLNQLRYSGMLETVRIRKAGYAVRRPFQDFYKRYKVLMRNLALPEDVRGKCTSLLQLYDASNS | 1881 | -72 through -1 |
| ID163 | MCLVSFFLELNVLQQ | 1882 | -15 through -1 |
| ID164 | MRSLACLTPCGHA | 1883 | -13 through -1 |
| ID165 | MHLLSNWANPASS | 1884 | -13 through -1 |
| ID166 | MWSGKWALVSPFAMLHSVWRLIPA | 1885 | -24 through -1 |
| ID167 | MKVHMHTKFCLICLLTFIFH | 1886 | -20 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID168 | MGRRHWVLTHSALSLFYTADTSHG | 1887 | -24 through -2 |
| ID169 | MAVFVVLLALVAGVLG | 1888 | -16 through -1 |
| ID170 | MAPLLLQLAVLGAALA | 1889 | -16 through -1 |
| ID171 | MPVTVTRTTITTTTTSSSGLGSPMIVGSPRALTQPLGLLRLLQLVSTCVA | 1890 | -50 through -1 |
| ID172 | MELVLVFLCSLLAPMVLA | 1891 | -18 through -1 |
| ID173 | MGPIWSSYYGNCRSLLFVMDASDPTQLSASCVQLLGLLSAEQLAEA | 1892 | -46 through -1 |
| ID174 | MSGGRAPAVLLGGVASLLLSFVVMPALLPVASRLLLLPRVLLTMASG | 1893 | -47 through -1 |
| ID175 | MALSCTLNRYLLLMAQEHLEFRLPEIXSLLLLFGGQFASS | 1894 | -40 through -1 |
| ID176 | MAARGVIAPVGESLRYAEYLQPSAKRPDADVDQQRLVRSLIAVGLGVAALAFA | 1895 | -53 through -1 |
| ID177 | MRMCAGSIYKSATQAVLGXLFLGGLCRG | 1896 | -28 through -1 |
| ID178 | MAERRRPLSPIPSXRRPSEPSRPPAAAGXRSLPRPGDEELQLPCAVHDLIFWRDVKKTGFVFGTTLIMLLSWQLSVS | 1897 | -78 through -1 |
| ID179 | MAAPVLLRVSVPRWERVARYAVCAAGILLSIYAYHVEREKERDPEHRALCDLGPWVKCSAALASRWGRGFGLLGSIFGKDGVLNQPNSVFGLIFYILQLLLGMTASAVA | 1898 | -109 through -1 |
| ID180 | MSFLQDPSFFTMGMWSIGAGALGAAALALLLANT | 1899 | -34 through -1 |
| ID181 | MASLLCCGPKLAACGIVLSAWGVIMLIMLGIFFNVHS | 1900 | -37 through -1 |
| ID182 | MILPYRMXSLFLHAVSSSFT | 1901 | -20 through -1 |
| ID183 | MATLVELPDSVLLEIFSYLPVRDRIRISRVCHRWKRLVDDRWLWRHVDLTLYTVRALAGRAWA | 1902 | -63 through -1 |
| ID184 | MKNACIVLPPTPPPSLQPSASLLAPNRFLFSCFCFLSHKFG | 1903 | -41 through -1 |
| ID185 | MAFGLQMFIQRKFPYPLQMSLLVAVAG | 1904 | -28 through -1 |
| ID186 | MYCKILVLMLHTELIRTDYSSVDQLLLNYPAEEGLGRERSLLWTPLLSPGSLR | 1905 | -53 through -1 |
| ID187 | MAVSHSVKERTISENSLILLQGLQG | 1906 | -26 through -1 |
| ID188 | MESGGRPSLCQFILLGTTSVVTA | 1907 | -23 through -1 |
| ID189 | MAALDLRAXWIRWSCCSCLGXLXGAGGETNGVERPGGGGLALARQGSLRDGRQVGRAPAVCFPHGAPGLPPRQRXXGGXPEVQGGESWCPRPRGGGASRTGLRRRKGPTKTPE PESSEAPQDPLNWFGILVPHSLRQAQA | 1908 | -139 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID190 | MAFLPSPAWWISLLPSLLSIC | 1909 | -21 through -1 |
| ID191 | MEPKVAELKQKIEDTLCPFGFEVYPFQVAWYNELLPPAFHLPLPGPTLA | 1910 | -49 through -1 |
| ID192 | MLVLRSGLTKALA | 1911 | -13 through -1 |
| ID193 | MSGGHLADLTLLFVLLLFSLLPA | 1912 | -23 through -1 |
| ID194 | MKPSRTPARLWMLPQQQAGAVVVAAPTERHPTHHMAGWLLGALTLLGLVTS | 1913 | -51 through -1 |
| ID195 | MGESIPLAAPVPVEQAVLETFFSHLGIFSYDKAKDNVEKEREANKSAGGSWLSLLAALAHLAAA | 1914 | -64 through -1 |
| ID196 | MQMSYAIRCAFYQLLLAALMLVAMLQLLYLSLLSGLHG | 1915 | -38 through -1 |
| ID197 | MLRAELKIAVVLFAFHLLLSFILG | 1916 | -24 through -1 |
| ID198 | MNHQQTLIGRLLCDLHGLSLSPPVANNVQALFRMLTPEAYSCLLILLLRTFLCSA | 1917 | -55 through -1 |
| ID199 | MIITAVVSISVTIFCFQTKVDFTSCTGLFCVLGIVLLVTG | 1918 | -40 through -1 |
| ID200 | MAAGGRMEDGSLDITQSIEDDPLLDAQLLPHHSLQAHFRPRFHPLPTVIIVNLLWFIHLVFVVLX | 1919 | -65 through -1 |
| ID201 | MSPCCMLLFVFGFVGG | 1920 | -16 through -1 |
| ID202 | MKLLLGIALLAYVAS | 1921 | -15 through -1 |
| ID203 | MDIIVPLIQLLVLLLTLPLHLMA | 1922 | -23 through -1 |
| ID204 | MEAASPSNSTGVERXADLMDADSLLLSLELASGSG | 1923 | -35 through -1 |
| ID205 | MIRQERSTSYQEAVRPALPSSKPCLLTSPAVLVKLLSSSASTS | 1924 | -43 through -1 |
| ID206 | MKLIDYGLSGYQBESAEVKAMDFITSTAILPLLFGCLGVFG | 1925 | -41 through -1 |
| ID207 | MRCLTTPMLLRALAQAARA | 1926 | -19 through -1 |
| ID208 | MSRFLNVLRSWLVMVSIIAMGNTLQSFRDHTFLYEKLYTGKPNLVNGLQARTFGIWTLLSSVIRCLC | 1927 | -67 through -1 |
| ID209 | MIFLTLSLDSRVSA | 1928 | -14 through -1 |
| ID210 | MQCFSFIKTMMILFNLLIFLCGAALLXVG | 1929 | -29 through -1 |
| ID211 | MAEFALEAVRXSYENSRPLQGSSACLLLCPTWTNP | 1930 | -35 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID212 | MATASPSVFLLMVNGQVES | 1931 | -19 through -1 |
| ID213 | MAGIKALISLSFGGAIGLMFLMLGCALP | 1932 | -28 through -1 |
| ID214 | MIGDILLFGTLLMNAGA | 1933 | -17 through -1 |
| ID215 | MKTMILTLSLFGSCIS | 1934 | -16 through -1 |
| ID216 | MDWRVPPSXXDPGHQDIPLPVTXXFISVVLSSLGIVLA | 1935 | -39 through -1 |
| ID217 | MAAAALPAWLSLQSRA | 1936 | -16 through -1 |
| ID218 | MAMVSAMSWVLYLWISACAMLLCHG | 1937 | -25 through -1 |
| ID219 | MGKEWGWQEMENGGAAPAWGAGPPVHPAPPVEKTLSWGCGFGLHSGPGGSGGVGLCRLLCLVRLFC | 1938 | -69 through -1 |
| ID220 | MLQTSNYSLVLSLQFLLLSYD | 1939 | -21 through -1 |
| ID221 | MWFEILPGLSVMGVCLLIPGLATA | 1940 | -24 through -1 |
| ID222 | MRPSLSGILADPLXLFPFSEG | 1941 | -22 through -1 |
| ID223 | MRESLSXRSWHLPASLMMAQXFIPAVA | 1942 | -27 through -1 |
| ID224 | MSGVVPTAPEQPAXEMENQTKPDPRPDAPPEYSSHXFTRTPWKQLSLHLLATRACYG | 1943 | -58 through -1 |
| ID225 | MWRYQFGWGVITRGPREIPFPPSLLASESLLPPLPDLVLTCTSLGFVTRVWMSLNLNELSLYSRTWVFTCLVFFCFG | 1944 | -77 through -1 |
| ID226 | MVKLLVAKILCMVGVFFFMLLGSSLLPVKI | 1945 | -29 through -1 |
| ID227 | MPVSIMCLIGLKANASS | 1946 | -17 through -1 |
| ID228 | MKVILLYIVLEKLVSRA | 1947 | -17 through -1 |
| ID229 | MAVTLSLLLGGRVCXPSLA | 1948 | -19 through -1 |
| ID230 | MLNQTSGRTSLLPELGVVTPAQG | 1949 | -23 through -1 |
| ID231 | MTSENLVQTAPKKKNKGKKGLEPSQSTAAAKVPKKAKTWIPEVHDQKADVSAWKDLFVPRPVLRALSFLGFSAPTIQA | 1950 | -79 through -1 |
| ID232 | MAAFGRQXXXWHXLIPLTWACMA | 1951 | -23 through -1 |
| ID233 | MSLTSSPKKRRSICFDRFLMPQSQSGPSSLGESYRTGVGFLIPEGWFLSGCPHGSSA | 1952 | -57 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID234 | MGELGNRSRCILFLSENPCLSESIFQSLXFCLSPPPSPS | 1953 | -39 through -1 |
| ID235 | MAELGLNEHHQNEVINIWMRFARSKRGLRLKTVDSCFQDLKESRLVEDTFTIDEVSEVLNGLQAVVHSEVESELINTAYTNVLLRQXFAQAEK | 1954 | -93 through -1 |
| ID236 | MVTLPSGTWAFSCPYLALVDGGMLGSAREDAHASVVSWAVGLLYAVAQG | 1955 | -49 through -1 |
| ID237 | MASASARGNQDKDAHFPPPSKQSLLFCPKXXLHIHRAEISKIMRECQEESFWKRALPFSLVSMLVTQG | 1956 | -68 through -1 |
| ID238 | MLLMKSILLKVVCVLCIYLKFKLMALIYVPDKNNTNNNILRYNHNEISIGISVQCHFILSLCVLCIVLT | 1957 | -69 through -1 |
| ID239 | MAQRLLLRRFLASVIS | 1958 | -16 through -1 |
| ID240 | MAASKVKQDMPPXGGYGPIDYKRNLPRRGLSGYSMLAIGIGTLIYGHWSIMKWNRERRLQIEDFEARIALLPLLQA | 1959 | -77 through -1 |
| ID241 | MRHLVTEELFPCSNLEDVVEDNSHSYFTLRITMACKGVPSTLLSLAILSHISTP | 1960 | -54 through -1 |
| ID242 | MSAEVKVTGQNQEQFLLLAKSAKGAALATLIHQVLEAPGVYVFGELLDMPNVRELAESXFASTFRLLXVFAYGTYA | 1961 | -76 through -1 |
| ID243 | MLLSIGMLMLSATQVXTILXVQLFAFLNLLPVEA | 1962 | -34 through -1 |
| ID244 | MGWEVVSLSYCGVSWG | 1963 | -16 through -1 |
| ID245 | MRECISVHVGQAGVQIGNACWELFCLEHGIQA | 1964 | -32 through -1 |
| ID246 | MAGPLQGGGAPALDLLRGLPRVSLA | 1965 | -25 through -1 |
| ID247 | MPAGVPMSTYLKMFAASXLAMCAGA | 1966 | -25 through -1 |
| ID248 | MAVQCVRLARRSLPALALSLRASP | 1967 | -24 through -1 |
| ID249 | MFSIISRSRACSMYFKENAKPSQLRLMHHYLSTPTSA | 1968 | -37 through -1 |
| ID250 | MKRLLPATSLAGPVLS | 1969 | -16 through -1 |
| ID251 | MLIITNPWPKYFDAAGRLTPEFSQRLTNKIRELLQQMERGLKSADXXDGTGYTGWAGIAVLYLHLYDVFG | 1970 | -70 through -1 |
| ID252 | MCATETVRAWLAQGSSSAGWG | 1971 | -21 through -1 |
| ID253 | MLLLATHPETVGQVTLRVXPVSLEVSIQMCAAAAAAFCLKXXGANT | 1972 | -46 through -1 |
| ID254 | MAASSATPAPXXSQRCGADAGSAARIVFRWGRGRRGARSPEGSGHHGRANSGLGGAQLQGGAX | 1973 | -64 through -1 |
| ID255 | MLRRPLAGLAAALGRA | 1974 | -17 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID256 | MDRPGFVAALVAGGVAG | 1975 | -17 through -1 |
| ID257 | MIVWFEGISMDLLTLLFQRRS | 1976 | -21 through -1 |
| ID258 | MRTFVHFALDALMFPARRA | 1977 | -20 through -1 |
| ID259 | MAAPPQLRALLVVNALLRKRRYHAAALAVLKGFRNGAVYGAKIRAPHALVMTFLFRNGSLQ | 1978 | -61 through -1 |
| ID260 | MPVDLGXALGLLPSLAKA | 1979 | -18 through -1 |
| ID261 | MNLFIMYMAGNTISIFPTMMVCMMAWRPIQALMAISATFKMLESSSQKFLQGLVYLIGNLMGLALAVYKCQS | 1980 | -72 through -1 |
| ID262 | MISLTDTQKIGMGLTGFGVFFLFFGMILFFDKALLAIGNVLFVAGLAFVIG | 1981 | -51 through -1 |
| ID263 | MAASGAPRILVDLLKLXVAPLAVFQMLKSMCAG | 1982 | -33 through -1 |
| ID264 | MASVSSATFSGHGARSLLQFLRLVGQ | 1983 | -26 through -1 |
| ID265 | MWYLAVLLVLFTLNIL | 1984 | -16 through -1 |
| ID266 | MFTFGRLFQIITVVTCLQFIQDCCIHSRQINSLLEXSSLSRC | 1985 | -42 through -1 |
| ID267 | MIQDRDRCAQAAAVAVGNLEPRGTPGPEDEAPCLPGCVGTLCQLDWWIWG | 1986 | -51 through -1 |
| ID268 | MKIIFPILSNPVPRRTVKILLCLLMIGYSQG | 1987 | -31 through -1 |
| ID269 | MVSRMVSTMLSGLLFWLASGWTPAFA | 1988 | -26 through -1 |
| ID270 | MTATLAAAADIATMVSGSSGLAXA | 1989 | -24 through -1 |
| ID271 | MSSWSRQRPKSPGGIQPHVSRTLFLLLLLAASAWG | 1990 | -35 through -1 |
| ID272 | MRVRIGLTLLLXAVLLSLASA | 1991 | -21 through -1 |
| ID273 | MFSHLPFDCVLLLLLLLTRS | 1992 | -21 through -1 |
| ID274 | MGPVRLGILLFLFLAVDEAWA | 1993 | -21 through -1 |
| ID275 | MKSLSLLAVALGLATA | 1994 | -17 through -1 |
| ID276 | MLLLTLXLLGGPTWA | 1995 | -16 through -1 |
| ID277 | MKIGILLSLLNSVISQTLMSCNWKQQMRRMKTILIILIXIWIWCLG | 1996 | -46 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID278 | MKASSGRCGLVRMLQVLLPFLLSLFPGALP | 1997 | -30 through -1 |
| ID279 | MIVDCVSSHLKKTGDGAKTFIIFLCHLLRGLHA | 1998 | -33 through -1 |
| ID280 | MAKALLFPSGRSVRVLYGAVNKERQXESVLNPACPPKANSKERRGPAVLGAELTQWSPTTAGSCCSSCTLCARSSSXVIAPSPLVPFTSGLTSLSWLLXASCS | 1999 | -104 through -1 |
| ID281 | MAASEAAVVSSPSLKTDTSPVLETAGTVAAMAATPSARAAAAVVAAAARTGSEARVSKAALATKLLSLSGVFA | 2000 | -73 through -1 |
| ID282 | MKVGVLWLISFFTFTDG | 2001 | -17 through -1 |
| ID283 | MEFGLSWIFLAAILKGVQC | 2002 | -19 through -1 |
| ID284 | MAEPGHSHHLSARVRGRTERRIPRLWRLLLWAGTAFQ | 2003 | -37 through -1 |
| ID285 | MTADPRKGRMGLQACLLGLFALILS | 2004 | -25 through -1 |
| ID286 | MLVDGPSERPALCFLLLAVAMSFF | 2005 | -24 through -1 |
| ID287 | MAAPLVLVLVVAVTVRA | 2006 | -17 through -1 |
| ID288 | MTAAIRRQRELSILPKVTLEAMNTTVMQGFNRSERCPRDTRIVQLVPPALYTVVFLTIGILLNTLALWVFVHIPSSSTFIIYLKNTLVADLXMTLMLPFKILS | 2007 | -102 through -1 |
| ID289 | MSSVLAASHPLVLSSNAGTPGISEKDNRDPAGSSIGVLTLSHLISG | 2008 | -46 through -1 |
| ID290 | MGLAMEHGGSYAPAGGSSRGCWYLRYFPLFVSLIQFLIILGLIVLFMVYG | 2009 | -50 through -1 |
| ID291 | MVEASLSVRHPEYNRPLLANDLMLIKLDESVSESDTIRSISIASQCPTAGNSCLVSGWGLLANG | 2010 | -64 through -1 |
| ID292 | MGGKQRDEDDEAYGKPVKYDPSPRGPIKNRSCTDVICCVLFLFILG | 2011 | -47 through -1 |
| ID293 | MQKASVLLFLAWVCFLFY | 2012 | -18 through -1 |
| ID294 | MSPVLHFYVRPSGHEGAASGHTRRKLQGKLPELQGVETELCYNVNWTAEALPSAEETKKLMWLFGCPYCWMMLLGSXGSFL | 2013 | -82 through -1 |
| ID295 | MDVTPRESLSILVVAGSGGHTTEILRLLGSLSNAYS | 2014 | -36 through -1 |
| ID296 | MMGVAKLTLLRVLNLPHNSIG | 2015 | -21 through -1 |
| ID297 | MDVTPRESLSILVVAGSGGHTTEILRLLGSLSNAYS | 2016 | -36 through -1 |
| ID298 | MVLLTMIARVADG | 2017 | -13 through -1 |
| ID299 | MVPVENTEGPSLLNQKGTAVETEGXGSRHPPWARGCGMFTFLSSVXA | 2018 | -47 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID300 | METFLEPNNKKLLFPVGRSWSCFA | 2019 | -24 through -1 |
| ID301 | MGFLWGLALPLFFC | 2020 | -15 through -1 |
| ID302 | MQSTSNHLWLLSDILGQGATA | 2021 | -21 through -1 |
| ID303 | MVEICAGSVLPPYSNC | 2022 | -16 through -1 |
| ID304 | MVAPVLETSHVFCCPNRVRGVLNWXSGPRGLLAFGTSCSVXXY | 2023 | -43 through -1 |
| ID305 | MDSLRKMLISVAMLGAXAGVGYALLVIVTPGERRKQEMLKEMPLQDPRSREEAARTQQLLLATLQEAATT | 2024 | -70 through -1 |
| ID306 | MRQTLPCIYFWGGLLPFGMLCASSTT | 2025 | -26 through -1 |
| ID307 | MADDLEQQSQGWLSSWLPTWRPTSMSQLKNVEARILQCLQNKFLARYVSLPNQNKIWTVTVSPEQNDRTPLVMVHGFGGGVGLWILNMDSLXARRTLHTXGLLGFGRXQG | 2026 | -110 through -1 |
| ID308 | MKVTGITILFWPLSMILLSDKIQS | 2027 | -24 through -1 |
| ID309 | MAAGRAQVPSSEQAWLEDAQVFIQKTLCPAVKEPNVQLTPLVIDCVKTVWLSQGRNQGSTLPLSYSFVSVQDLKTHQRLPCCSHLSWSSSAYQAWA | 2028 | -96 through -1 |
| ID310 | MSTCCWCTPGGAST | 2029 | -14 through -1 |
| ID311 | MPPAEDKTYKYICRNFSNFCXVDVVEILPLYLPCLTA | 2030 | -36 through -1 |
| ID312 | MAESEDRSLRIVLVGKTGSGKSATANTILGEEIFDSRIAAQAVTKNCQKASREWQGRDLLVDTPGLFDTKESLXTTCKEIXRCIISSCPGPHAIVLVLLLGRYTEE | 2031 | -107 through -1 |
| ID313 | MAQKPLRLLACGDVEGKFDILFNRVQAIQKXSGNFDLLXCVGNFFGSTQ | 2032 | -49 through -1 |
| ID314 | MESRKDITNQEELWKMKPRRNLEDDYLHKDTGETSMLKRPVLLHLHQTAHA | 2033 | -52 through -1 |
| ID315 | MESRKDITNQEEXWKMKPRRNLEDDYLHKDTGETSMLKRPVLLHLHQTAHA | 2034 | -52 through -1 |
| ID316 | MAATCEISNIFSNYFSAMYSSEDSTLASVPPAATFG | 2035 | -36 through -1 |
| ID317 | MRDCPGVEXILDCSXRQKTEGCRLQAGKECVDSPVEGGQSEAPPSLVSFAVSSEGTEQ | 2036 | -58 through -1 |
| ID318 | MERQSRVMSEKDEYQFQHQGAVELLVFNFLLILTILT | 2037 | -37 through -1 |
| ID319 | MKMASSLAFLLLNFNVSLLLVQLLTPCSA | 2038 | -29 through -1 |
| ID320 | MVFLPLKWSLATMSFLLSSLLALLTVSTPSWC | 2039 | -32 through -1 |
| ID321 | MESAAALHFSRPASLLLLLXCVHWS | 2040 | -26 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID322 | MEKIPVSAFLLLVALSYTLA | 2041 | -20 through -1 |
| ID323 | MGPWGEPELLVWRPEAVASEPPVPVGLEVKLGALVLLVLTLLCSL | 2042 | -46 through -1 |
| ID324 | MAPLLLQLAVLGAALA | 2043 | -16 through -1 |
| ID325 | MAMEGYWRFLXLLGSALLVGFLSVIFA | 2044 | -27 through -1 |
| ID326 | MAQSLALSLLILVLAFG | 2045 | -17 through -1 |
| ID327 | MEAMWLLCVALAVLA | 2046 | -15 through -1 |
| ID328 | MAPITTSREEFDEIPTVVGIFSAFGLVFTVSLFAWICC | 2047 | -38 through -1 |
| ID329 | MEGPRGWLVLCVLAISLA | 2048 | -18 through -1 |
| ID330 | MTAWEAMAPHVNPTLKDKALSPQQXXXTSPAPCXSNHHNKKHLILAFCAGVLLTLLLIAFIFL | 2049 | -63 through -1 |
| ID331 | MLCSLLLCECLLLXAGYA | 2050 | -18 through -1 |
| ID332 | MGHAMGLVXSLPVHCLTFA | 2051 | -19 through -1 |
| ID333 | MARCFSLVLLLTSIWT | 2052 | -16 through -1 |
| ID334 | MLLTRKQTCQLGILLSIHRQHSKDLQDIVATLGPRSATHPQPAIQVLAQLAFLSQISQ | 2053 | -59 through -1 |
| ID335 | MWAFSELPMPLLINLIVSLLGFVATVTL | 2054 | -28 through -1 |
| ID336 | MFKVIQRSVGPASLSLLTFKVYA | 2055 | -23 through -1 |
| ID337 | MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGLQRLPLISVALVQGWALG | 2056 | -136 through -1 |
| ID338 | MTSFSTSAQCSTSDSACRISPGQINXVRPKLPLLKILHAAGAQG | 2057 | -44 through -1 |
| ID339 | MDTAEEDICRVCRSEGTPEKPLYHPCVCTGSIKXVHQECLVQWLKHSRKEYCELCKHRFAFTPIYSPDMPSRLPIQDIFAGLVTSIGTAIRYWFHYTLVAFAWLGVVPLTAC | 2058 | -112 through -1 |
| ID340 | MLIMLGIFFNVHS | 2059 | -13 through -1 |
| ID341 | MGGLWRPGWRCVPFCGWRMIHPGSPTRAAERVEPFLRPEWSGTGGAERGLRWLGTWKRCSLRARHPALQPPRRPKSSNPFTRAXEEERRRXNKTTLTYVAAVAVGMLXASYA | 2060 | -112 through -1 |
| ID342 | MAAQCVTKVALNVSCANLLDKDIGSKSDPLCVLFLNTSG | 2061 | -39 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID343 | MTGSNEFKINQPPEDGISSVKFSPNTSQFLLVSSWDTSVRLYDVPANSMRLKYQHTGAVLDCAFYDPTHA | 2062 | -70 through -1 |
| ID344 | MGKHLWYPGQASAHLCWCGSHCCST | 2063 | -25 through -1 |
| ID345 | MLAVSLTVXLLGA | 2064 | -13 through -1 |
| ID346 | MSSTLAKIAEIEAEMARTQKNKATAHHIGLLKARLAKLRRELITPKGGGGGPGEGFDMPRQVMLELDLLVFHLMG | 2065 | -76 through -1 |
| ID347 | MAAAVPKRMRGPAQAKLLPGSAIQALVGLARPLVLALLLVSAALS | 2066 | -45 through -1 |
| ID348 | MTPQSLLQTTLFLLSLLFIVQGAHG | 2067 | -25 through -1 |
| ID349 | MMVVGTGTSLALSSLLSLLLFAGMQIYSRQLASTEWLTIQGGLLGSGLFVFSLTAFNNLENLVFGKGFQAKIFPEILLCLLLALFASG | 2068 | -88 through -1 |
| ID350 | MDWTWRVFCLLAVAPGAHS | 2069 | -19 through -1 |
| ID351 | MRIANRTRFPSSPPLARGAGWTHGRGMMVVGTGTSLALXSLLSLLLFAGMQMYSRQLASTEWLTIQGGLLGSGLFVFSLTAFNNLENLVFGKGFQAKIFPEILLCLLLALFASG | 2070 | -113 through -1 |
| ID352 | MTSVSTQLSLVLMSLLLVLPVVEA | 2071 | -24 through -1 |
| ID353 | MTPLLTLIIVVLMGLPLAQA | 2072 | -20 through -1 |
| ID354 | MALLLALSLLVLWTSP | 2073 | -16 through -1 |
| ID355 | MGGLEPCSRLLLLPLLLAVSG | 2074 | -21 through -1 |
| ID356 | MEVPPPAPRSFLCRALCLFPRVFA | 2075 | -24 through -1 |
| ID357 | MDLRQFLMCLSLCTAFALS | 2076 | -19 through -1 |
| ID358 | MAGVRPLRGLRALCRVLLFLSQFCILSGG | 2077 | -30 through -1 |
| ID359 | MAAAWLQVLPVILLLGAHP | 2078 | -21 through -1 |
| ID360 | MRTLFNLLWLALACSPVHT | 2079 | -19 through -1 |
| ID361 | MDVLFVAIFAVPLILG | 2080 | -16 through -1 |
| ID362 | MAAAAWLQVLPVILLLLGAHP | 2081 | -21 through -1 |
| ID363 | MRTLFNLLXLALACSPVHT | 2082 | -19 through -1 |
| ID364 | MGSKVADLLYWKDTRTSGVVFTGLMVSLLCLLHFSIVSVA | 2083 | -40 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID365 | MAARWRFWCVSVTMVALLIVCDVPSASA | 2084 | -29 through -1 |
| ID366 | MEGESTSAVLSGFVLGALA | 2085 | -19 through -1 |
| ID367 | MFAPAVMRAFRKNKTLGYGVPMLLIVGGSFG | 2086 | -32 through -1 |
| ID368 | MAAAWXSGPSAPEAVTARLVGVLMFVSVTTGPWGAVATSAGGEESLKCEDLKVGQYICKDPKINDATQEPVNCTNYIAHVSCFPAPNITCKDSSGNETHFTGNEVGFFKPISCRNVNGYSYKVAVALSLFLGWLGA | 2087 | -136 through -1 |
| ID369 | MRTLFNLLMLALACSPVHT | 2088 | -19 through -1 |
| ID370 | MDGQKKNWKDKVVDLLYWRDIKTGVVFGASLFLLLSLTVFS | 2089 | -42 through -1 |
| ID371 | MVAPGLVLGLVLPLILWA | 2090 | -18 through -1 |
| ID372 | MSPSGRLCLLTIVGLILPTRG | 2091 | -21 through -1 |
| ID373 | MRIANRTRFSLPFLARGAGWTHGRGMMVVGTGTSLALSSLLSLLLFA | 2092 | -47 through -1 |
| ID374 | MVLGGCPVSYLLLCGQAALLLGNLLLLHCVSRSHS | 2093 | -35 through -1 |
| ID375 | MGSVLGLCSMASWIPCLCGSAPCLLCRCCPSGNNSTVTRLIYALFLLVGVCVA | 2094 | -53 through -1 |
| ID376 | MVLLHVLFEHAVGYALALLAKEVEEISLLQPQVEESVLNLGKFHSIVRLIVAFCPFASS | 2095 | -57 through -1 |
| ID377 | MSGGPAPAVLLGGVASLLLSFVMMPALLPVASRLLLLPRVLLTMASG | 2096 | -47 through -1 |
| ID378 | MVAPVWYLVAAALLVGFILFLTRSRG | 2097 | -26 through -1 |
| ID379 | MAVLAPLIALVYSVPRLSRWLAQPYYLLSALLSAAFLLVRKLPPLCHG | 2098 | -48 through -1 |
| ID380 | MVGEAGRDLRRRRXXAVTAXKMAVLAPLIALVYSVPRLSRWLAQPYYLLSALLSAAFLLVRKLPPLCHG | 2099 | -69 through -1 |
| ID381 | MEALGKLKQFDAYPKTLEDFRVKTCGGATVTIVSGLLMLLLFLSELQY | 2100 | -48 through -1 |
| ID382 | MAVLAPLIALVYSVPRLSRWLAQPYYLLSALLSAAFLLVRKLPPLCHG | 2101 | -48 through -1 |
| ID383 | MRCLTTPMLLRALAQAARA | 2102 | -19 through -1 |
| ID384 | MRCLTTPMLLRALAQAARA | 2103 | -19 through -1 |
| ID385 | MDFITSTAILPLLFGCLGVFG | 2104 | -21 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID386 | MHPAVFLSLPDLRCSLLLLVTWVFTPVTT | 2105 | -29 through -1 |
| ID387 | MASLGHILVFCVGLLTMAKA | 2106 | -20 through -1 |
| ID388 | MSGSSLFSALALSLLLVSGSLLP | 2107 | -23 through -1 |
| ID389 | MAVHDLIFWRDVKKTGFVFGTTLIMLLSLAAFSVIS | 2108 | -36 through -1 |
| ID390 | MKGSVECTXGWGHCAPSPLLWTLLLFAAPFG | 2109 | -32 through -1 |
| ID391 | MQCFSFIKTMMILFNLLIFLCGAALLAVG | 2110 | -29 through -1 |
| ID392 | MRGSVECTWGXGHCAPSPLLWTLLLFAAPFG | 2111 | -32 through -1 |
| ID393 | MALRLLKLAATSASA | 2112 | -15 through -1 |
| ID394 | MPSAFSVSSFPVSIPAVLTQTDWTEPWLMGLATFHALCVLLTCLSSRSYRLQIGHFLCLVILVYC | 2113 | -65 through -1 |
| ID395 | MALPHQEPKPGDLIEIFRLGYEHWALYIXDGYVIHLAPPSEYPGAGSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFA | 2114 | -154 through -1 |
| ID396 | MAASTSMVPVAVTAAVAPVLSINSDFSDLREIKKQLLLIAGLTRERGLLHSSKWSAELAFSLPALPLAEL | 2115 | -70 through -1 |
| ID397 | MEEGGNLGGLIKMVHLLVLSGAWG | 2116 | -24 through -1 |
| ID398 | MAGPAAAFPRLGALSGAAALGFASYGAHGAXPPDAYGKELFDKANKHHFLHSLALLGVPHCRKPLWAGLLLASGTTLFCTS | 2117 | -81 through -1 |
| ID399 | MGHRFLRGLLTLLLPPPPLYT | 2118 | -21 through -1 |
| ID400 | MELLQVTILFLLPPSICSSNS | 2119 | -20 through -1 |
| ID401 | MASSNTVLMRLVASAYSIA | 2120 | -19 through -1 |
| ID402 | MRSSCVLLTALVALA | 2121 | -15 through -1 |
| ID403 | MGIQTSPVLLASLGVGLVTLLGLAVG | 2122 | -26 through -1 |
| ID404 | MTLQWAAVATFLYAEIGLLIFCLPFIPPQRWQKIFSNVWGKIATFWNKAPLTIIILLIVLFLDAVRE | 2123 | -69 through -1 |
| ID405 | MPSEGRCWETLKALRSSDKGRLCYYRDWLLRREVSGGPGGRRPFRPLATETFSLAVGTFCSREPVQSNNLHLFLDFCVYIPLSWG | 2124 | -85 through -1 |
| ID406 | MTKLAQWLWGLAILGSTWVALTTG | 2125 | -24 through -1 |
| ID407 | MLLAWVQAFLVSNMLLAEAYG | 2126 | -21 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID408 | MAMHFIFSDTAVLLFHFWSVHSPAGMALSVLVLLLAVLYE | 2127 | -41 through -1 |
| ID409 | MKQVHQCIERCHVPLAQAQALVTSELEKPQDRLARCTMHCNDKAKDSIDAGXKELQVKQQLXVVXXSVLXTTCXS | 2128 | -75 through -1 |
| ID410 | MQMSYAIRCAFYQLLLAALMLVAMLQL | 2129 | -27 through -1 |
| ID411 | MMTQTCIILLIHTMQVCTT | 2130 | -19 through -1 |
| ID412 | MXXHLQTRPLFLTCLFWPLAAL | 2131 | -22 through -1 |
| ID413 | MAANYSSTXTRREHVKVKTSSQPGFLERLSETSGGMFVGLMAFLLSFYLIFT | 2132 | -52 through -1 |
| ID414 | MRGAHLTALEMLTAFASHIBA | 2133 | -21 through -1 |
| ID415 | MVHKPMMTQTCIILLIHTMQVCTT | 2134 | -24 through -1 |
| ID416 | MAGIKALISLSFGGAIGLMFLMLGCALP | 2135 | -28 through -1 |
| ID417 | MSLMPKMHLLFPLTLVRSFWS | 2136 | -21 through -1 |
| ID418 | MMKRAAAAAVGGALAVGAVPVVLSAMGFTGAGIAASSIAAKMMSAAAIANGGGVSAGSLVATLQSVGAAGLSTSSNILLASVGSVLG | 2137 | -87 through -1 |
| ID419 | MVTIILLLSCXFWA | 2138 | -14 through -1 |
| ID420 | MXKRAAAAAVGGALAVGAVPVVLSANGFTGAGIAASSIAAKMMSAAAIANGGGVSAGSLVATLQSVGAAGLSTSSNILLASVGSVSG | 2139 | -87 through -1 |
| ID421 | MSQDGGXGELKHMVMSFRVSELQVLLGXXGRNKSGRKHELLAKALHLLKSSCAPSVQMKIKELYRRRPPRKTLGPSDLSLLSLPPGTSP | 2140 | -89 through -1 |
| ID422 | MPXILLPVASRLLLLPRVLLTMASG | 2141 | -24 through -1 |
| ID423 | MVFSNNDEGLINKKLPKELLLRIFSFLDIVTLCRC | 2142 | -35 through -1 |
| ID424 | MVFSNNDEGLINKKLPKELLLRIFSFLDIVTLCRC | 2143 | -35 through -1 |
| ID425 | MASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKTNS | 2144 | -112 through -1 |
| ID426 | MPLILSLQVCRPATL | 2145 | -15 through -1 |
| ID427 | MLGITSCSDQQAKEGEGLEGSSTGSSSGNHGGSGGGNHKPGCEKPGNEARGSGNLGFRTLRRLLGCLTLTLS | 2146 | -73 through -1 |
| ID428 | MARKALKLASWTSMALA | 2147 | -17 through -1 |
| ID429 | MAAAALPAWLSLQSRA | 2148 | -16 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID430 | MVKIAFNTPTAVQKEEARQDVEALLSRTVRTQILTGKELRVATQEKEGSSGRCMLTLXXLSFILA | 2149 | -65 through -1 |
| ID431 | MIGSGLAGSGAGGPSSTVTWCALXSNHVAATQASLLLSFVWMPALLP | 2150 | -48 through -1 |
| ID432 | MSGAQLXGFLFXVIVLTS | 2151 | -18 through -1 |
| ID433 | MSFFQLLMKRKELIPLVVFMTVAASGASS | 2152 | -29 through -1 |
| ID434 | MELAHSLLLNEEALA | 2153 | -15 through -1 |
| ID435 | MTSALTQGLERIPDQLGYIVLSEGAVLA | 2154 | -28 through -1 |
| ID436 | MRAAWPSGPXAPEAVTARLVGVLMFVSVTTG | 2155 | -31 through -1 |
| ID437 | MVLLTMIARVADG | 2156 | -13 through -1 |
| ID438 | MVLLTMIARVADG | 2157 | -13 through -1 |
| ID439 | MTSQPVPNETIIVLPSNVINFSQAEKPEPTNQGQDSLKKKHLHAEIKVIGTIQILCGMMVLSLGIXLASA | 2158 | -69 through -1 |
| ID440 | MASVVLALRTRTAVTSLLSPTPATA | 2159 | -25 through -1 |
| ID441 | MASVVLALRTRTAVTSLLSPTPATA | 2160 | -25 through -1 |
| ID442 | MMPSRTNLATGIPSSKVKYSRLSSTDDGYIDLQFKKTPPKIPYKAIALATVLFLIGA | 2161 | -57 through -1 |
| ID443 | MPLILSLQVCRPATL | 2162 | -15 through -1 |
| ID444 | MPLILSLQVCRPATL | 2163 | -15 through -1 |
| ID445 | MASSVGNVADSTEPTKRMLSFQGLAELAHREYQAGDFEAAERHCMQLWRQEPDNTGVLLLLSSIHFQC | 2164 | -68 through -1 |
| ID446 | MFGSAPQRPVAMTAQRDSLLWKLAGLLREXGDVVLSGCSTLSLLTPTLQQLNHVFELHLGPWGPGQTGFVALPSHPADSPVILQLFLFDVLQ | 2165 | -94 through -1 |
| ID447 | MSFIFEWIYNGFSSVLQFLGLYKKSGKLVFLGLDNAGKTTLLHMLKDRLGQHVPTLHPTSEELTIAGMTLQLLILVGTSKHVAFG | 2166 | -86 through -1 |
| ID448 | MDKPCGCPPGVCDHGTGDRRDPWYSTVGLLPVRA | 2167 | -35 through -1 |
| ID449 | MAAALKCLLTLGRWCPGLGVAPQARALAALVPGVTQ | 2168 | -36 through -1 |
| ID450 | MVARVWSLMRFLIKGSVAGGAVILVYDQELLGPSDKSQAALQKAGEVVPPAMXQFSQYVCQQTGLQIPQLPAPPKIYFPIRDSWXAGIMTVMSALSVAPSKA | 2169 | -102 through -1 |
| ID451 | MVNELQNLXSLQGSQA | 2170 | -16 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID452 | MLYMSLKYIRAFFFSIQPFLPCSS | 2171 | -24 through -1 |
| ID453 | MNLERVSNEEKLNLCRKYYLGGFAFLPLMLVNIFWFFREAFLVPAYTEQSQIKGYVWRSAVGFLFWVIVLTSWITIFQ | 2172 | -79 through -1 |
| ID454 | MAGELQGTQAPSLRGXGLTSQDSGVNPNNSXRGREAMASGSNWLSGVNVVLVMAYGSLVFVLLFIFVKRQ | 2173 | -70 through -1 |
| ID455 | MTGFLLPPASRGTRRSCSRSRKRQTRRRRNPSSFVASCPTLLPFACVPGASPTTLA | 2174 | -56 through -1 |
| ID456 | MEEXSXPLVEFVKVLCTNQVLITARA | 2175 | -26 through -1 |
| ID457 | MVRRLXXVVAFVAPGES | 2176 | -17 through -1 |
| ID458 | MAVPGVGLLTRLNLCARRRTRVQRPIVRLLSCPGTVA | 2177 | -37 through -1 |
| ID459 | MMAAVPPGLEPWNRVRIPKAGNRSAVTVQNPGAALDLCIAAVIKECHLVILSLKSQTLDA | 2178 | -60 through -1 |
| ID460 | MASLDRVKVLVLGDSGVGKSSLVHLLCCNQVLG | 2179 | -33 through -1 |
| ID461 | MVFPAKRFCLVPSMEGVRWAFSCCGTWLPSRA | 2180 | -31 through -1 |
| ID462 | MASKIGSRRWMLQLIMQLGSVLLTRC | 2181 | -26 through -1 |
| ID463 | MLSKGLKRKREEEEEKEPLAVDSWWLDPGHA | 2182 | -31 through -1 |
| ID464 | MDYSLAAALTLHGHWG | 2183 | -16 through -1 |
| ID465 | MSYITSQEMKCILHWFANWSGPQRERFLEDLVAKAVPEKLQPXLDSLEQLSVSGADDHLLSLXASYIFGISG | 2184 | -72 through -1 |
| ID466 | MPLLCQIEMEYLLLKWQMTMLQSMLCDLVSYPLLPLQQTKEANLDFPKIKVSSVTITPTRWFXLIVULMVVSFIAS | 2185 | -76 through -1 |
| ID467 | MWFEILPGLSVMGVCLLIPGLA | 2186 | -22 through -1 |
| ID468 | MEFKLEAHRIVSISLGKIYNSRVQRGGIKLHKNLLVSLVLRXPAKS | 2187 | -46 through -1 |
| ID469 | MAVLSKEYGFVLLTGAASFIMVAHLAINVSKARKKYKVEYPIMYSTDPENGHIFNCIQRAHQNTLEVYPXFLFFLAVGGVYHPRIASGLGLXLDCWT | 2188 | -97 through -1 |
| ID470 | MDGHWSAAFSALTVTAMSSWARRRSSSSRRIPSLPGSPVCWA | 2189 | -42 through -1 |
| ID471 | MAQRLLLRRFLASVIS | 2190 | -16 through -1 |
| ID472 | MASLKPAFVNYFFLLLEVSHLLLI | 2191 | -25 through -1 |
| ID473 | MNLERVSNEEKLNLCRKYYLGGFAFLPLMLVNIFWFFREAFLVPAYTEQSQIKGYVWRSAVGFLFWVIVLTSWITI | 2192 | -77 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID474 | MAQLGAVVAVASSFFCASLFS | 2193 | -21 through -1 |
| ID475 | MSLRNLWRDYKVLVFMVPLVGLIHL | 2194 | -25 through -1 |
| ID476 | MGMDGCKCLGVFCLLISIPTPSA | 2195 | -23 through -1 |
| ID477 | MAASQAVEEMRTAWFWGSLGFAMSILLTFPVTIPVMMPGTRXGFEXRXFRVDVHMDENSLEFDMVGIDAAIANAFRRILLAEVPTMAVEKVLVYNNTSIVQDEILAHRLGLIPIHA | 2196 | -118 through -1 |
| ID478 | MAASKVKQDMPPGGYGPIDYKRNLPRRGLSGYSMLAIGIGTLIYGHWSIMKWNRERRLQIEDFEARIALLPLLQA | 2197 | -77 through -1 |
| ID479 | MSGFLEGLRCSECIDWGEKRNTIASIAAGVLFFTGWWIIIDA | 2198 | -42 through -1 |
| ID480 | MMTQEPGIYTWPEKTRIICSACSSVPLPWTVLVFLTFLSIPSFV | 2199 | -44 through -1 |
| ID481 | MFLTALLWRGRIPG | 2200 | -14 through -1 |
| ID482 | MNQENPPYPGPGPTAPYPPYPPQMPGPXMGGPYPPPQGYPPQGYPQYGWQGGPQEPPKTTVYVVEDQRRDELGPSTCLTACWTALCCC | 2201 | -90 through -1 |
| ID483 | MASLEVSRSPRRSRRELEVRSPRQNKHSVLLPTYNERELPLIVWLLIVKSFSES | 2202 | -54 through -1 |
| ID484 | MCPTCLCAPSXXWG | 2203 | -14 through -1 |
| ID485 | MAAATGAVAASASGQAEG | 2204 | -19 through -1 |
| ID486 | MAAMSLLXRVSVTAVAA | 2205 | -17 through -1 |
| ID487 | MAGPLQGGGARALDLLRGLPRVSLA | 2206 | -25 through -1 |
| ID488 | MATATEQNVLVEMVQALYEAPAYHLILEGILILWIIRLLFS | 2207 | -41 through -1 |
| ID489 | MEDPNPEENMXQQDSPKERSPQSPGGNICHLGAPKCTRCLIITFADSKXXERHMKREHPADFVAQKLQGVLFICFTCARS | 2208 | -79 through -1 |
| ID490 | MNVIDHVRDMAAAGLHSNVRLLSSLLLTMSNN | 2209 | -32 through -1 |
| ID491 | MQNVINTVKGKALEVAEYLTPVLKESKFKETGVITPEEFVAAGDHLVHHCPTWQWATG | 2210 | -58 through -1 |
| ID492 | MATLTFSLRKPLQRSLIRPSHLPLCCFDWRLSHYYRLPPAVRLHQQRGGRPGRSSADHWHSGVPTRILPPAHRLLCIQRLPWLLLCRG | 2211 | -88 through -1 |
| ID493 | MEKPLFPLVPLHWFGFGYTALVVSGGIVGYVKTGSVPSLAAGLLFGSXA | 2212 | -49 through -1 |
| ID494 | MASTVVAVGLTIAAAGFA | 2213 | -18 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID495 | MVIRVYIASSSGSTAIKKKQQDVLGFLEANKIGFEEKDIAANEENRKWMRENVPENSRPAVQGPHAFRYKAFSFSRLLSQCRP | 2214 | -83 through -1 |
| ID496 | MSSRGHSTLPRTLMAPRMISEGDIGGIAQITSSLFLGRGSVA | 2215 | -42 through -1 |
| ID497 | MAAPGPALCLFDVDGTLT | 2216 | -18 through -1 |
| ID498 | MPLGARILFHGVFYAGGFA | 2217 | -19 through -1 |
| ID499 | MLLSIGMLMLSAT | 2218 | -13 through -1 |
| ID500 | MSLTSSSVRVEMIAAVTIAAGTAA | 2219 | -25 through -1 |
| ID501 | MSGSNGSKENSHNKARTSPYPGSKVERSQVPNEKVGWLVEWQDYKPVEYTAVSVLAGPRWA | 2220 | -61 through -1 |
| ID502 | MAISLRSSGISVKCLSKLWMRWTVTSTTRA | 2221 | -30 through -1 |
| ID503 | MSEVRLPPLRALDDFVLGSARLGGSGS | 2222 | -27 through -1 |
| ID504 | MKLVSATAWLEECWN | 2223 | -15 through -1 |
| ID505 | MKAISVSLLRLIKLLWFFSIVLYVPLLAVCCLHS | 2224 | -34 through -1 |
| ID506 | MGSLSGLRLAAGSCFRLCERDVSXSLRLTRSSDLKRINGFCTKPQESPGAPSRTYNRVPLHKPTDWQKKILIWSGRFKKEXXIPETVSLEMLXXAKNKMRVKISYLMIALTVVGCIFM | 2225 | -118 through -1 |
| ID507 | METLYRVPFLVLECPNLKLKKPWLHMPSAMTVYALVVVSYFLITGGIIYDVIVEPPSVGSMTDEHGHQRPVAFLAYRVNGQYIMEGLASSFLFTMGGLG | 2226 | -100 through -1 |
| ID508 | MLVLRSGLITKALA | 2227 | -13 through -1 |
| ID509 | MAAPLSVEVEFGGGAXSCLTVLRNIESLAWTGGTLG | 2228 | -36 through -1 |
| ID510 | MTHLIEYDRHRKSRLSPLQHLYLLPADHSRNAAERFPGAWFQPPTVDSEASAFVGGLPVIFWSWA | 2229 | -65 through -1 |
| ID511 | MAAALGQIWARKLLSVPWLLC | 2230 | -22 through -1 |
| ID512 | MAVESRVTQEEIKKEPEKPIDREKTCPLLLLVFTTNNG | 2231 | -38 through -1 |
| ID513 | MRLKYQHTGAVLDCAFYDPTHA | 2232 | -22 through -1 |
| ID514 | MALLFARSLRLCRWGAKRLGVASTEAQRGVSFKLXEKTAHSSLALFRDDTGVKYGLVGLEPTKVALNVERFREWAVVLADTAVTSG | 2233 | -86 through -1 |
| ID515 | MAAAAAGTXTSQRFFQSFSDALIDEDPQAALEELTKALEQKPDDAQYYCQRAYCHILLGNYCVAVADA | 2234 | -68 through -1 |
| ID516 | MAQLKYMENVGYAQEDRERMRHRNIVSLAQNLLNFMIGSILDLWQCFLMFYIGSSLNGTRG | 2235 | -60 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID517 | MSPAFRAMDVEPRAKGSFWSPLSTRSGGTHA | 2236 | −31 through −1 |
| ID518 | MADEELEALRRQRLAELQAKHGDPGDAAQQEAKHREAEMRNSILAQVLDQSARA | 2237 | −54 through −1 |
| ID519 | MSAAGARGLRATYHRLLDKVELMLPEKLRPLYNHPAGPRTVFFWAPIMKWGLVCAGLADMARP | 2238 | −63 through −1 |
| ID520 | MSNYSVSLVGPAPWGFRLQGGKDFNMPLTISSLKDGGKAAQANVRIGDVVLSIDGINAQGMTHLEAQNKIKGCTGXLNMTLQRASA | 2239 | −86 through −1 |
| ID521 | MANPKLLGLELSEAEAIG | 2240 | −18 through −1 |
| ID522 | MIIPLLEILIIIVLNEVLLFDVNSVYKALLCTLLLHFQNI | 2241 | −40 through −1 |
| ID523 | MDIQMANNFTPPSATPQGNDCDLYAHHSTARIVMPLHYSLVFIIGLVGNLLA | 2242 | −52 through −1 |
| ID524 | MLTIVKSPQKSYLFPSSMIGIGSLPSCWA | 2243 | −29 through −1 |
| ID525 | MVLVALILLHSALA | 2244 | −14 through −1 |
| ID526 | MAQHHLWILLLCLQTWPEAAG | 2245 | −21 through −1 |
| ID527 | MKDLWIFLLLVTAPRCILS | 2246 | −19 through −1 |
| ID528 | MAQHHLWILLLCLQTWPEAAG | 2247 | −21 through −1 |
| ID529 | MDWTWRFLFVVAAATGVQS | 2248 | −19 through −1 |
| ID530 | MSICFLGLLLLCLLPHRLA | 2249 | −19 through −1 |
| ID531 | MIGFLVLLILPLLSSLS | 2250 | −17 through −1 |
| ID532 | MQCLLSVLMAQFIXHFLSLLMSLLVSTVTMQ | 2251 | −31 through −1 |
| ID533 | MELGLSWIFFLATLKGVQC | 2252 | −19 through −1 |
| ID534 | MVSVSLALLSGWVGS | 2253 | −15 through −1 |
| ID535 | MPLPWSLALPLLLSWVAGGFG | 2254 | −21 through −1 |
| ID536 | MVSNFFHVIQVFEKSATLISKTEHIGFVIYSWXKSTTHLGSRRKFAISIYLSEVSLQKYDCPFSGTSFVVFSLFLICAMA | 2255 | −80 through −1 |
| ID537 | MRXFWFLMYPFRFHDCKQKYDLYISIAGWLIICLACVLFPLLRT | 2256 | −44 through −1 |
| ID538 | MVSLCCLFTCFFIPCIS | 2257 | −17 through −1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID539 | MDFFFLERSYWGKMILLLVTYSPIAYS | 2258 | -27 through -1 |
| ID540 | MTMRHNWTPDLSPLWVLLLCAHVVTL | 2259 | -26 through -1 |
| ID541 | MDNMSGGKVDEALVKSSCLHPWSKRNDVSMQCSQDILRMLLSLQPVLQ | 2260 | -48 through -1 |
| ID542 | MXLQGQRATGKVLIKIHKDTSQVPTAXGDASIAALVLWTLPGAQR | 2261 | -45 through -1 |
| ID543 | MTEHSLTHQGIPILVLILFPTSCVM | 2262 | -25 through -1 |
| ID544 | MYIGGLRFIFLTSLQLISS | 2263 | -19 through -1 |
| ID545 | MSVSLKHIHLFIIMSVLVFWNCSHLIFFSLIFLNLFA | 2264 | -38 through -1 |
| ID546 | MXXLGXXRFMVSFLSXPPLCSA | 2265 | -22 through -1 |
| ID547 | MDWTWYILVSVAAATGAHS | 2266 | -19 through -1 |
| ID548 | MISKFSSKAYSVRGLELFSLLPINPSPNSAIXVACVLSSLIAVNS | 2267 | -45 through -1 |
| ID549 | MVLLGAFGSCIKSFSLLFLIFSLNLNRG | 2268 | -28 through -1 |
| ID550 | MAARQAVGSGAQETCGLDRILEALKLLLSPGXSGS | 2269 | -35 through -1 |
| ID551 | MSTQKGLALFLMALGFSCI | 2270 | -19 through -1 |
| ID552 | MKDVEIIMIFHGYFLIVFFVFLCNC | 2271 | -25 through -1 |
| ID553 | MCFPEHRRQMYIQDRLDSVTRRARQGRICAILLLQSQCAYWA | 2272 | -42 through -1 |
| ID554 | MLVVKQCFSDSSILSTFVSWLSA | 2273 | -23 through -1 |
| ID555 | MIXLRDTAASLRLERDTRQLPLLTSALHGLQQ | 2274 | -32 through -1 |
| ID556 | MITMMLALISVCLF | 2275 | -14 through -1 |
| ID557 | MWLLTLVQCSDLCPS | 2276 | -15 through -1 |
| ID558 | MRVHLFPYLCQPSVLSNFLLFACLTMLLVKT | 2277 | -31 through -1 |
| ID559 | MIPLCFLILPYPVLS | 2278 | -15 through -1 |
| ID560 | MAGSRLPRQLFLQGVXASSCLLSXPSTRKSQA | 2279 | -32 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID561 | MYICFCLESFEIKCGFVLHLLAQDLVCC | 2280 | -28 through -1 |
| ID562 | MHFILHNLNAFTLLVWLSLS | 2281 | -20 through -1 |
| ID563 | MSFFPFNRSLNSNPHPNLLFPNIAPLFTLLPKSIP | 2282 | -35 through -1 |
| ID564 | MVVWVLEVRFLLDLHCFCSLAKT | 2283 | -23 through -1 |
| ID565 | MVCGWWTQGPVPGLCCPALGSAWS | 2284 | -24 through -1 |
| ID566 | MGRAFPSRHKTARFECALVSASLTTA | 2285 | -26 through -1 |
| ID567 | MGLKALCXXLLCVLFVSH | 2286 | -18 through -1 |
| ID568 | MMATQTLSIDSYQDGQQMQVVTELKTEQDPNCSEPDAEGVSPPPVESQTPMDVDKQAIYRHPLFPLLALLFEKCEQ | 2287 | -76 through -1 |
| ID569 | MSPSQLTCSVFLSGSVCLSFL | 2288 | -21 through -1 |
| ID570 | MLQALAPAHHLCSLKRSFCSLLCLRTQLFP | 2289 | -30 through -1 |
| ID571 | MLFLKYLMWRSLCRG | 2290 | -14 through -1 |
| ID572 | MALLAMHSWRWAAAAAFEKRRHSAILIRPLVSVSGS | 2291 | -37 through -1 |
| ID573 | MKAXAMFGAGDEDDTDFLSPSGGARLASLFGLDQXAAG | 2292 | -38 through -1 |
| ID574 | MLWLLRSLTDVSS | 2293 | -13 through -1 |
| ID575 | MTIFHVLIAHSSSFS | 2294 | -15 through -1 |
| ID576 | MHWQLLXGFCGSYSA | 2295 | -15 through -1 |
| ID577 | MTMMVMASFLPRNTMYTNTMNYSIFVFLLFFFSXLXY | 2296 | -37 through -1 |
| ID578 | MPSQTLSQPRISVLHGDLVPAGMAVQEIGAQMVLPCEVVSGSGLTREHLVTRLALCQSPRA | 2297 | -61 through -1 |
| ID579 | MSLRVHTLPTLLGAVVRPGCRELLCLLMITVTVGPGAS | 2298 | -38 through -1 |
| ID580 | MIYLTSLLLLGRWLTLTS | 2299 | -18 through -1 |
| ID581 | MNWNVRGTRGFLLCPLVCGLRR | 2300 | -22 through -1 |
| ID582 | MEQAALEVVSPLPRRCSVRSPVTTCCAKDLVCLTFITATTHE | 2301 | -42 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID583 | MIIPLPSLVGCWEGGNGKGLMVSDTTCWTLASSNVPSPSPAPTLGRGAPSHTPQKKPTIPGARHRPIILPKGLVQLHATXLALG | 2302 | -84 through -1 |
| ID584 | MSMRLSGERIYLLLEVWLPXLNPESVLHPIQTVHIALPGSLG | 2303 | -42 through -1 |
| ID585 | MGTLLLFCFMPVVINP | 2304 | -16 through -1 |
| ID586 | MVVLNPMTLGIYLQLFFLSIVS | 2305 | -22 through -1 |
| ID587 | MAPHTASFGVCPLLSVTRVVATEHWLFLASLSGIKT | 2306 | -36 through -1 |
| ID588 | MSYKWMPSLPCLLSFCTLCLV | 2307 | -20 through -1 |
| ID589 | MPLPTWAPTLAGFLLVLYVCLP | 2308 | -22 through -1 |
| ID590 | MNLYLLDWIGLKALIRG | 2309 | -17 through -1 |
| ID591 | MSCXVXDAXXRWAHXLLIGWXHLTQKVHPIALSHCVNMGTLLLFCFMPVVINP | 2310 | -54 through -1 |
| ID592 | MVPNLCGRQILAPQTFLLNLRA | 2311 | -22 through -1 |
| ID593 | MFSLIIFFPPSSP | 2312 | -14 through -1 |
| ID594 | MSAFYLSYSLLHCLLIVPILVEF | 2313 | -23 through -1 |
| ID595 | MAEAKLVQSLVAPQRXSAGVVLTMDGASA | 2314 | -30 through -1 |
| ID596 | MKGVGPEQLNDGAPSNEIEMTPCFFSEFLLLDVGVVNIVIKMSYNVLLTISTNASVLG | 2315 | -59 through -1 |
| ID597 | MLRKLSASNENLCLLSNPSHNEVYLIRCCESHQLFWVTASTPCRS | 2316 | -45 through -1 |
| ID598 | MYPLILLPLNPFVLQ | 2317 | -15 through -1 |
| ID599 | MLLRPSPGSPRGFVAVGLGQISA | 2318 | -23 through -1 |
| ID600 | MARPGATACGPAAHQCSA | 2319 | -18 through -1 |
| ID601 | MEPVSSLSLCIXXLEHLFT | 2320 | -19 through -1 |
| ID602 | MRPAGRWCSAAAWRSPLSA | 2321 | -19 through -1 |
| ID603 | MWLCAYVLFFFNGCLY | 2322 | -16 through -1 |
| ID604 | MLLLHRAVVLRLQQA | 2323 | -15 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID605 | MEMFGXXEKDFSSVEGVLXSLVPSMCFHVTNS | 2324 | -32 through -1 |
| ID606 | MQMHGWRMDPHSSEQLDLAHTLSREASLENNTALLGVHASFQMSVA | 2325 | -46 through -1 |
| ID607 | MASPRGTDYNQTPNTTMCYAVGTGVLTSRLARA | 2326 | -34 through -1 |
| ID608 | MAPILSSFKSLLKYHLLETSLSILLKPVTLHCLCPFPALFLS | 2327 | -42 through -1 |
| ID609 | MNRLSKHLIILVPWWLPPFVYT | 2328 | -22 through -1 |
| ID610 | MSSNKEQRSAVFVILFALITILILYSSNS | 2329 | -29 through -1 |
| ID611 | MDMKSNTGHGLFLGRQPSFSVRSMPGTPALAICQPHNPGPPMGTPTEDPSGCSFPCLFLSPQSFLVLS | 2330 | -68 through -1 |
| ID612 | MSEAGCKPSRPEHGSFLSLSSTLLLTSHH | 2331 | -29 through -1 |
| ID613 | MESGXGXVFLVALLRGVQC | 2332 | -19 through -1 |
| ID614 | MLCRLFTLLLLQSLLLG | 2333 | -17 through -1 |
| ID615 | MDLLHKNMKHLWFLLLVAGPRNVLS | 2334 | -26 through -1 |
| ID616 | MQAQAPVVVTQPCVGPGPAPQNSNWQTGMCDCFSDCGVCLCGTFCFPCLG | 2335 | -51 through -1 |
| ID617 | MKALCLLLLPVLGLLVSS | 2336 | -18 through -1 |
| ID618 | MSPSGRLCLLXIVGLXLPTXG | 2337 | -21 through -1 |
| ID619 | MLLAWVQAFLVSNMLLAEAYG | 2338 | -21 through -1 |
| ID620 | MLSESRGPPVQEHEAPVVLPPAGGGSQMGPVPAAXAGESGPGXVKPLETLXLTCSVSGGSIS | 2339 | -62 through -1 |
| ID621 | MTSGQAPASXQSPQALEDSGPVNISVSITLTLDPLKPFGGYSRNVTHLYSTILGHQIGLSGREAHEEINITFTLPTAWSSDDCALHGHCEQVVFTACMTLTASPGVFP | 2340 | -108 through -1 |
| ID622 | MLGGDHRALLLKIWLLQRPES | 2341 | -21 through -1 |
| ID623 | MRPRKAWAPVLAALSHSLMSLLDESSCQA | 2342 | -29 through -1 |
| ID624 | MVVWPCAVVLAQYLWFHRRSLPGKAILEIGAGVSLPGILAAKCGAEVILSDSSELPHCLEVCRQSCQMNNLPHLQVVGLTWG | 2343 | -82 through -1 |
| ID625 | MLNPAQXDTMPCEYLSLDAMEKWIIFGFILCHGILNTXATALNLWKLALQSSSCLS | 2344 | -56 through -1 |
| ID626 | MNAQASSRCHGVCLSVPSLPSIS | 2345 | -24 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID627 | MAKVQVNNVVLDNPSPYNPFQFEITPECIEDLSEDLEWKIIYVGSAESEEYDQVLDSVLVGPVPA | 2346 | -67 through -1 |
| ID628 | MADVEDGEETCALASHSGSSG | 2347 | -21 through -1 |
| ID629 | MWTCLLGDCGPPEA | 2348 | -14 through -1 |
| ID630 | MDWTWXVFCLLAVAPGAHS | 2349 | -19 through -1 |
| ID631 | MDNSWRLGPAIGLSAGQSQLLVSLLLLTRVQP | 2350 | -33 through -1 |
| ID632 | MXHLXFPLLLVAAPRWVLS | 2351 | -19 through -1 |
| ID633 | MPVPASWPHPPGPFLLLTLLLGLTEVAG | 2352 | -28 through -1 |
| ID634 | MKEYVLLLFLALCSA | 2353 | -15 through -1 |
| ID635 | MAQSLALSLLILVLAFG | 2354 | -17 through -1 |
| ID636 | MKKVLLLITAILAVAVG | 2355 | -17 through -1 |
| ID637 | MKKVLLLITAILAVAVG | 2356 | -17 through -1 |
| ID638 | MRIMLLFTAILAPSLAQS | 2357 | -18 through -1 |
| ID639 | MAWTVLLLGLLSHCTVS | 2358 | -17 through -1 |
| ID640 | MTILHTGXNPFRPSQRWTAPALLHHRPXTXPPSXHRSRCTEXVGIPXLLLQTLPASTX | 2359 | -58 through -1 |
| ID641 | MKHLWFFLLLLVAAPKXXLS | 2360 | -20 through -1 |
| ID642 | MLSYFLSSLVCGSLGLSNVSG | 2361 | -21 through -1 |
| ID643 | MGTQDPQAEQGLRIPLPGLLLSKHHHPAPELPALALLHAGHA | 2362 | -42 through -1 |
| ID644 | MMTIYALSNEFAFKINEEQLSXXPLXSVQLXHA | 2363 | -33 through -1 |
| ID645 | MRGAHLXALEMLTAFASHIRA | 2364 | -21 through -1 |
| ID646 | MNPESPQQLERQSTGPRTGTRRCLSKFTWCTSRMMTQTCIILLIHTMQVCTT | 2365 | -52 through -1 |
| ID647 | MMTQTCIILLIHTMQVCTT | 2366 | -19 through -1 |
| ID648 | MAGKGSSGRRPLLLGLLVAVATVHL | 2367 | -25 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID649 | MAGSPTCLTLIYILWQLTGSAA | 2368 | -22 through -1 |
| ID650 | MVGMVCFIILGLLICIQC | 2369 | -18 through -1 |
| ID651 | MXLLHSLSSGVRA | 2370 | -13 through -1 |
| ID652 | MTMAECPTLCVSSSPALWA | 2371 | -19 through -1 |
| ID653 | MVPLVAVVSGPRAQLFACLLRLGTQ | 2372 | -25 through -1 |
| ID654 | MSEMAELSELYEESSDLQMDVMPGEGDLPQMEVGSGSRELSLRPSRSGAQQLEEEGPMEEEAQPMAXQRGNGALLTGPTLGSSQA | 2373 | -86 through -1 |
| ID655 | MLIVSVLALIPXTT | 2374 | -15 through -1 |
| ID656 | MTCRGSCSYATRRSPSELSLLPSSLWVLA | 2375 | -29 through -1 |
| ID657 | MEAVVFVFSLLDCCA | 2376 | -15 through -1 |
| ID658 | MAATSGTDEPVSGELVSVAHALSLPAQSYG | 2377 | -30 through -1 |
| ID659 | MADEALFLLLHNEMVSG | 2378 | -17 through -1 |
| ID660 | MASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSC | 2379 | -119 through -1 |
| ID661 | MKXMTGSENWKTKKVLMFCVTPPELET | 2380 | -27 through -1 |
| ID662 | MQHIVGVPHVLVRRGLLGRDLFMTRTLCSPGPS | 2381 | -33 through -1 |
| ID663 | MYHQSEALALASSQSHLLG | 2382 | -19 through -1 |
| ID664 | MSGQGLAGFFASVAMICAIASG | 2383 | -22 through -1 |
| ID665 | MPTGKQLADIGYKTFSTSMMLLTVYGGYLC | 2384 | -30 through -1 |
| ID666 | MFPVCLTVTAAVCG | 2385 | -14 through -1 |
| ID667 | MSVIFFACVVRVRDG | 2386 | -15 through -1 |
| ID668 | MLXGGLKMAPRGKRLSSTPLEILFFLNGWYNATYFLLELFIFLYKGVLLPYPTANLVLDVMLLLYLG | 2387 | -68 through -1 |
| ID669 | MIGGGRWDPPGAQAPSSQAFPRRPALTILIHLPGTEG | 2388 | -36 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID670 | MVRRVQPDRKQLPIVLRLLCLLPTGLP | 2389 | -28 through -1 |
| ID671 | MPLHYSLVFIIGLVGNLLA | 2390 | -19 through -1 |
| ID672 | MARGLGAPHWVAVGLLTWATLGLLVAGLGG | 2391 | -30 through -1 |
| ID673 | MVFVHLYLGNVLALLLFVHYSNG | 2392 | -23 through -1 |
| ID674 | MGMCFAAESDVQMFIAFLLCIFLICAALA | 2393 | -29 through -1 |
| ID675 | MAVRELCFSRQRQVLFLFWGVSLA | 2394 | -26 through -1 |
| ID676 | MRILQLILALATGLVGG | 2395 | -18 through -1 |
| ID677 | MRILQLILALATGLVGG | 2396 | -18 through -1 |
| ID678 | MRSCLWRCRHLSQGVQWSLLLAVLVFFLFA | 2397 | -30 through -1 |
| ID679 | MRILQXILALATGLVGG | 2398 | -18 through -1 |
| ID680 | MLEECGAGVDLGPGGVKFASETPNLLWLLLKLVSTXWA | 2399 | -38 through -1 |
| ID681 | MIACSIRELHRCLLLALVAESSS | 2400 | -23 through -1 |
| ID682 | MGPPSLVLCLLSATVFS | 2401 | -17 through -1 |
| ID683 | MPGPRVWGKYLWRSPHSKGCPGAMWWLLLWGVLQX | 2402 | -35 through -1 |
| ID684 | MHRPEAMLLLTLALLGGPTWX | 2403 | -22 through -1 |
| ID685 | MVSVSLALLSGWVGS | 2404 | -15 through -1 |
| ID686 | MHIFSICMXSELHKMKSLSLQASEKRSLVALVEEIVFLLLRVSPCLG | 2405 | -49 through -1 |
| ID687 | MKLWVSALLMAWFGVLS | 2406 | -17 through -1 |
| ID688 | MKVLISSLLLLLPLMLMSMVSS | 2407 | -22 through -1 |
| ID689 | MKVLISSLLLLLPLMLMSMVSS | 2408 | -22 through -1 |
| ID690 | MLLLLQLSLPSPTS | 2409 | -14 through -1 |
| ID691 | MLKMLSFKLLLLAVALG | 2410 | -17 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID692 | MHRPEAMLLLTLALLGXXXWA | 2411 | -22 through -1 |
| ID693 | MLKVSAVLCVCAAAWC | 2412 | -16 through -1 |
| ID694 | MKVGVLWLISFFTFTDG | 2413 | -17 through -1 |
| ID695 | MCIILLDLICLLFITA | 2414 | -16 through -1 |
| ID696 | MDCASISVKFTSMATMHDLSQFWASRGEVTNWMPVGQTSLPLFYLAFMVFGSFFPLISC | 2415 | -59 through -1 |
| ID697 | MTASPDYLVVLFGITAGATG | 2416 | -20 through -1 |
| ID698 | MVCVLVLAAAAGAVA | 2417 | -15 through -1 |
| ID699 | MKKTGDGGTLSTERIGGAALLSLLLKRMKMTLMIPLLLLTPITA | 2418 | -44 through -1 |
| ID700 | MELGCWTQLGLTFLQLLLISSLP | 2419 | -23 through -1 |
| ID701 | MRXKWKMGGMKYIFSLLFFLLLEGGXT | 2420 | -27 through -1 |
| ID702 | MRGATRVSIMLLLVTVSDC | 2421 | -19 through -1 |
| ID703 | MIAISAVSSALLFSLLCEAST | 2422 | -21 through -1 |
| ID704 | MIAISAVSSALLFSLLCEAST | 2423 | -21 through -1 |
| ID705 | MDPNGGCCTLLTLVLCVAVAYE | 2424 | -22 through -1 |
| ID706 | MEGEIYFQVFLSLFTFSTSLPSSLS | 2425 | -25 through -1 |
| ID707 | MYVVAMFGNCIVVFIVRTERSLHAPMYLFLCMLAAIDLALS | 2426 | -41 through -1 |
| ID708 | MRETXPLPKPLKDTAPSSHGVGSDSPSATRPWFLAPWCPGTQS | 2427 | -43 through -1 |
| ID709 | MDRPGSLSVFGSLPASLGTWLSSPAWLVDRPVRSAHPSANSTGVRMSVLVVLALRSLGRS | 2428 | -60 through -1 |
| ID710 | MHYFVAGKVILLFSYPSCCLC | 2429 | -22 through -1 |
| ID711 | MDLNSASTVLQVLTQATS | 2430 | -29 through -1 |
| ID712 | MSSCNFTHATFVLIGIPGLEKAHFWVGPPLLSMYVVAMFGNCIVVFIVRTERSLHAPMYLFLCMLAAIDLALS | 2431 | -73 through -1 |
| ID713 | MYRLSLIAGPGSYPVLRWGVWDIPSSLVQVTYHQPNLTTNLDLPLFFSCSISATHS | 2432 | -56 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID714 | MLVDGPSERPALCFLLLAVAMSFF | 2433 | -24 through -1 |
| ID715 | MPCSLTWRLPPRTCQXXGLXKSXLXXLLTPPPSYG | 2434 | -35 through -1 |
| ID716 | MVXWLVLFALQIYSYXSTRDQPASRXRLLFLFLTSIAEXCS | 2435 | -42 through -1 |
| ID717 | MARHGLPLLXXXSLPVGA | 2436 | -18 through -1 |
| ID718 | MVHLRTGLMLMSADRLRTLYYTVTILYILMYCSVCSS | 2437 | -37 through -1 |
| ID719 | MGILSTVTALTFARA | 2438 | -15 through -1 |
| ID720 | MELGCWTQLGLTFLQXLLISSLX | 2439 | -23 through -1 |
| ID721 | MELLRVCSFFLLCXSVFTDCKG | 2440 | -22 through -1 |
| ID722 | MIVRPRLNLTWFLLLPPGQCRA | 2441 | -22 through -1 |
| ID723 | MQFLFKMVALCCCLWKISG | 2442 | -19 through -1 |
| ID724 | MLKVSAVLCVCAAXXSQSLX | 2443 | -21 through -1 |
| ID725 | MSMQFLFKMVALCCCLWKISG | 2444 | -21 through -1 |
| ID726 | MAQHLWILLGSLSCRTS | 2445 | -17 through -1 |
| ID727 | MNKEXVSXERXAQVRLYLFSGFWTFXLG | 2446 | -28 through -1 |
| ID728 | MVLWRAKIXRNVPVTLSEENRSEGKVGPQAYKNYFRAGAHWIVFIFLLLNTAA | 2447 | -54 through -1 |
| ID729 | MLLXFFTSVLWLTSPSQP | 2448 | -18 through -1 |
| ID730 | MELISPTVIIILGCLALFLLLQ | 2449 | -22 through -1 |
| ID731 | MHGFEIISLKEESPLGKVSQGPLRNVTSGSSSPVTWLGLLSFQNLHC | 2450 | -47 through -1 |
| ID732 | MTWRHAPGKSLEWATVTDGGDKTFYAASVKGRFNVSRDNSKNTLFLHLSGLSAA | 2451 | -56 through -1 |
| ID733 | MLTSFFSLTANCQS | 2452 | -14 through -1 |
| ID734 | MLLCLLTPLFFMXPTGFS | 2453 | -18 through -1 |
| ID735 | MDDYEAVHSLFLSLLGLCPS | 2454 | -21 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID736 | MEWGKQWLVWLLLGHMVVS | 2455 | -19 through -1 |
| ID737 | MRRGKRLLESQSSSPKACLQLGFETELTQGVLMLVLIQA | 2456 | -39 through -1 |
| ID738 | MVAATEAALLESVVWLPCHG | 2457 | -20 through -1 |
| ID739 | MSWNPSVSLPLLSSWGSTA | 2458 | -19 through -1 |
| ID740 | MKRIQGILFLILLSLHLERRWT | 2459 | -22 through -1 |
| ID741 | MVQRLWVSRLLRHRKAQLXLXNLLTFGLEVCLAAG | 2460 | -35 through -1 |
| ID742 | MAAGVPFALVTSCSSVFS | 2461 | -18 through -1 |
| ID743 | MTVFLXFCFPRCHS | 2462 | -14 through -1 |
| ID744 | MXPNNFWQKLGRKKPRIFTCTQSSTGEAAVKAENLILLEVFVWNGLQG | 2463 | -48 through -1 |
| ID745 | MFRSDRMWXCHWKWKPSPLLFLFALYIMCVPHSVWG | 2464 | -36 through -1 |
| ID746 | MTQRSIAGPICNLKFVTLLVALSSELPFLGA | 2465 | -31 through -1 |
| ID747 | MIIPLLLLRSACN | 2466 | -14 through -1 |
| ID748 | MXSPLPVLLLSXNLNLIIQ | 2467 | -19 through -1 |
| ID749 | MLMCKMLKSQKNCQENXXIKIILFLKPMCSPQYLLTFLVFTXKLSS | 2468 | -46 through -1 |
| ID750 | MKKKSSPNQYLHSSLHXIRLFSFLHFSEEGVLLLAIDLKIIVILHCAASIIS | 2469 | -52 through -1 |
| ID751 | MFSCFFSTSLATSVSLEAQSCFA | 2470 | -23 through -1 |
| ID752 | MHHGLTPLLLGVHEQKQQVVKFLIKKKANLNALDRYGRTALILAVCCGSA | 2471 | -50 through -1 |
| ID753 | MSPCIYFFACFQALTSS | 2472 | -17 through -1 |
| ID754 | MAEMESSLEAXFSSSGAVSGASGFLPPARS | 2473 | -31 through -1 |
| ID755 | MAEMESSLEASFSSSGAVSGASGFLPPARS | 2474 | -31 through -1 |
| ID756 | MLVLGSPLLGPLLWHLSLILLKPLCLP | 2475 | -27 through -1 |
| ID757 | MHLLDLESMGKSSDGKSYVITGSWNPKSPHFQVNEETPKDKVLFMTTAVDLVIT | 2476 | -55 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID758 | MENLKDFVLFVFSSIPLTFL | 2477 | -21 through -1 |
| ID759 | MPQYCLSIFSLVLPVCRM | 2478 | -18 through -1 |
| ID760 | MVAPVLETSHVFCCPNRVRGVLNWSSGPRGLLAFGTSCSVVLY | 2479 | -43 through -1 |
| ID761 | MPIIDQVNPELHDFMQSAEVGTIFALSWLITWFGHXLS | 2480 | -38 through -1 |
| ID762 | METXCPCCCCCPCXGXGSLXXKPVYELQVQKSVTVQEGLCVLVPCSXSXX | 2481 | -49 through -1 |
| ID763 | MSPCIYFFACFXXLTSS | 2482 | -17 through -1 |
| ID764 | MGRGERRHYWGPKLVLKCLSFSXPSLP | 2483 | -27 through -1 |
| ID765 | MSQDGGXGELKHMVMSFRVSELQVLLGFAGRNKSGRKHELLAKALHLLKSSC | 2484 | -52 through -1 |
| ID766 | MHHRMNEMNLSPVGMEQLTSSSVSNALPVSGSHLGLAASPTHSAIPAPGLPVAIPNLGPSLSSLPSALS | 2485 | -69 through -1 |
| ID767 | MLHSDNIWNLFSLFSTSTT | 2486 | -19 through -1 |
| ID768 | MQPASPPARWSFHSAAGWSGGGQA | 2487 | -24 through -1 |
| ID769 | MCFSFLLAGSISHMFSQA | 2488 | -18 through -1 |
| ID770 | MYGFIIGLSILFHCSVCLFLC | 2489 | -21 through -1 |
| ID771 | MSFGXILTFRVSLLGCXLAININT | 2490 | -24 through -1 |
| ID772 | MAVYVGMLRLGRLCAGSSGVXG | 2491 | -22 through -1 |
| ID773 | MFNTIYLVISLVSIFFFWEVTNA | 2492 | -23 through -1 |
| ID774 | MALPPKGCGSLPLTTGSSWSLS | 2493 | -22 through -1 |
| ID775 | MFVFLSWASFLAPLLR | 2494 | -16 through -1 |
| ID776 | MXMKSANKITLLXHHLLSCSPLXPLGKS | 2495 | -28 through -1 |
| ID777 | MCNYNIYVLYNIGYLYHPKSFLLLFIVIPQTP | 2496 | -32 through -1 |
| ID778 | MAVAMVKLCERAGLPLLAAPLLRSLLP | 2497 | -27 through -1 |
| ID779 | MLNVRALRXPQWCAEYCLSIHYQHGGVICTQVHKQTVVQLALRVADEMDVNIGHEVGVIPPENCCTNETILRYCTDDMLQREMMSNPFLGSYGVIILDDIHERSIATDVLLGLLKDVLLA | 2498 | -122 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID780 | MHAGLERXSXQKALAGLCIGSTSYVHG | 2499 | -27 through -1 |
| ID781 | MLNGPFQHRNSRIMTHRSAEKTLLGSLSLWRWSAM | 2500 | -35 through -1 |
| ID782 | MRVKDPTKALPEKAKRSKRPTVPHDEDSSDDIAVGLTCQHVSHA | 2501 | -44 through -1 |
| ID783 | MPQKGLGLLGILSGDFSLLALSMLKGTG | 2502 | -28 through -1 |
| ID784 | MAWWNRPXXXLPQQPLXAEPTAEGEPHLPTGRXXTEANRFAYAALCGISLSQLFP | 2503 | -55 through -1 |
| ID785 | MLCFGDLLLSPWTVPVWS | 2504 | -19 through -1 |
| ID786 | MQENAHNLRLFKCLLIYFLGLAADTYF | 2505 | -27 through -1 |
| ID787 | MHTCSLPCLLFAQLLEFCSFPPDVPHNCAPIVSVRPPNIVAAFEGCSVATALFPPLCIS | 2506 | -59 through -1 |
| ID788 | MQQRGAAGSRGCALFPLLGVLFPQGVYI | 2507 | -28 through -1 |
| ID789 | MXXSIFISEKYGLCPSKTPIMKMLPSLILNRSLPTASSS | 2508 | -39 through -1 |
| ID790 | MAPDVSCFFWVLFSAGCKV | 2509 | -20 through -1 |
| ID791 | MEVAANCSLRVKRPLLDPRFEGYKXSLEPLPCYQLELDAAVAXVKLRDDQYTLEHMHAFGMYNYLHCDSWYQDSVYYIDTLGRIMNLTVMLDTAXG | 2510 | -96 through -1 |
| ID792 | MNVGTAHXXVNPNTRVMNSRGIWNLSYVLAIGLLHIVLLS | 2511 | -39 through -1 |
| ID793 | MENFNMYKNKSWWTLLSSSPSFM | 2512 | -23 through -1 |
| ID794 | MNVGTXHSEVNPNTRVMNSRGIWNLSYVLAIGLLHIVLLS | 2513 | -39 through -1 |
| ID795 | MAAASAVSVLLVAA | 2514 | -14 through -1 |
| ID796 | MAYSKASGSPVLSQAVPGENASHRRGSADLGSGSGLSWARLSQS | 2515 | -44 through -1 |
| ID797 | MKPRRNLEEDDYLHKDTGETSMLKRPVLLHLHQTAHA | 2516 | -37 through -1 |
| ID798 | MIICYDIPCAHMLVCPTIG | 2517 | -19 through -1 |
| ID799 | MYSSEDSTLASVPPAATFG | 2518 | -19 through -1 |
| ID800 | MGEDPXQPRKYKXKXELQGDXPPSSPTNDPTVKYETQPRFITATGGTLHMYQLEGLLNWLRFSWA | 2519 | -65 through -1 |
| ID801 | MFYVAMTKTHKRIRSLCNIHHGLFQFTQQLLGCLQCCWLQSG | 2520 | -42 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID802 | MVSPKDLPLVLLQDIKVPSSMTGSHAGNPHIERNDLPRHGSPQFFTGXTCASXNPSQCLA | 2521 | -60 through -1 |
| ID803 | MEFXSLFCLYFSCFL | 2522 | -15 through -1 |
| ID804 | MALHFQSLAELEXLCTHLYIGTDLTQRIEAEKALLELIDSPECLS | 2523 | -45 through -1 |
| ID805 | MRTLFGAVRAPFSSLTLLLITPSPSPL | 2524 | -27 through -1 |
| ID806 | MRHSLLKGISAQIVSAADKVDAGLPTAIAVSSLIAVGTSHG | 2525 | -41 through -1 |
| ID807 | MTLSCFIFFYISSLC | 2526 | -15 through -1 |
| ID808 | MILCFLLPHHRLQEA | 2527 | -15 through -1 |
| ID809 | MFSLFALNMPLGFC | 2528 | -14 through -1 |
| ID810 | MASSPGVAMHSLWATIHTSVWGVLPPPACSA | 2529 | -31 through -1 |
| ID811 | MSQEGAVPASAVPLEELSSWPEELCRRELPSVLPRLLSLSQHSES | 2530 | -45 through -1 |
| ID812 | MTRECPSPAPGPGAPLSGSVLAEAAVVPAVVLSIHA | 2531 | -36 through -1 |
| ID813 | MQELHLLWWALLLGLAQA | 2532 | -18 through -1 |
| ID814 | MGRQALLLLALCATGAQG | 2533 | -18 through -1 |
| ID815 | MGPSTPLLILFLLSWSGPLQG | 2534 | -21 through -1 |
| ID816 | MSCRELTHRPCSPHLLLLCPLSRGCCP | 2535 | -27 through -1 |
| ID817 | MGWTMRLVTAALLLGLMMVVTG | 2536 | -22 through -1 |
| ID818 | MKFLIFAFFGGVHLLSLCSGKVYA | 2537 | -24 through -1 |
| ID819 | MQCFSFIKTMMILFNLLIFLCGAALLAVG | 2538 | -29 through -1 |
| ID820 | MWAFSELPMPLLINLIVSLLGFVATVTL | 2539 | -28 through -1 |
| ID821 | MASSNTVLMRLVASAYSIA | 2540 | -19 through -1 |
| ID822 | MKFLIFAFFGGVHLLSLCSGKAIC | 2541 | -24 through -1 |
| ID823 | MADTTPNGPQGAGAVQFMMTNKLDTAIVIWLSRLFTVYCSALXVLPLLGLHEA | 2542 | -51 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID824 | MRFRHFXXIGXVLVLSVVXXAMA | 2543 | -24 through -1 |
| ID825 | MELGSCLEGGREAAEERGEPEVKKRRLLCVEFASVASCDA | 2544 | -40 through -1 |
| ID826 | MASPFSGALQLTDLDDFIGPSQECIKPVKVEKRAGSGVAKIREDDGSYFQINQDGXTRRLEKAKVSLNYCXACSGCITSAETVLITQQSHELKKVLDANKMAAPSQQRLVVVSVSPQSRA | 2545 | -122 through -1 |
| ID827 | MGPVPTAVAGAGSRLVRPSQTLSLTCAVSGGSLVAELLLGAGSG | 2546 | -44 through -1 |
| ID828 | MESGGRPSLCQFILLGTTSVVTA | 2547 | -23 through -1 |
| ID829 | MQVCRCIYIICFXLPPLFS | 2548 | -19 through -1 |
| ID830 | MAQRLLLRFLASVIS | 2549 | -15 through -1 |
| ID831 | MLFIFNFLFSPLPTPALICILIFGAAIFLWLITRPQPVLP | 2550 | -40 through -1 |
| ID832 | MYPKWEAPVTFCQLKREKDPPHPAHSPFLQPRFSHMLQLLPSKALC | 2551 | -46 through -1 |
| ID833 | MALYQRWRCLRLQGLQACRLHTAVVSTPPRWLAERLGLFEELWA | 2552 | -44 through -1 |
| ID834 | MGVPRPQPWAXGLLLFLLPGSLG | 2553 | -23 through -1 |
| ID835 | MAAAVPKRMRGPAQAKLLPGSAIQALVGLARPIVLALXLIVSAALS | 2554 | -45 through -1 |
| ID836 | MWLWEDQQGLLGPFSFLLVLLLVTRXRS | 2555 | -29 through -1 |
| ID837 | MNWELLLWLLVLCALLLLLVQLLRFLRA | 2556 | -28 through -1 |
| ID838 | MEKIPVSAFLLLVALSYTLA | 2557 | -20 through -1 |
| ID839 | MSNYTDAESSFSKQEIIRVAMEKIPVSAFLLLVALSYTLA | 2558 | -40 through -1 |
| ID840 | MQFXTWATSSSQPALWSLLLVSWAAMLRLRSKCALVTFFFILLLIFIAEVAA | 2559 | -53 through -1 |
| ID841 | MNWELLLWLLVLCALLLLLVHLLRFLPA | 2560 | -28 through -1 |
| ID842 | MTTFLPVPQMMAGFSGTFGNPPMESPSAWQTIHQPFIVSCLTLWSPGCWP | 2561 | -51 through -1 |
| ID843 | MASKGMRHFCLISEQLVXFSLLATAILG | 2562 | -28 through -1 |
| ID844 | MAAAAWLQVLPVILLLLGAHP | 2563 | -21 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID845 | MASPRTVTIVALSVALGLFFVFMGTIKLTPRLSKDAYSEMKRAXKSYVRALPLLKKMGINSILLRKSIGALEVACGIVMTLVPGRPKDVANFPLLLLVLAVLPFHQLVG | 2564 | -109 through -1 |
| ID846 | MPNLSFGGLDTNQMRVNFLSVDVCKLLLLCALHSHIYC | 2565 | -38 through -1 |
| ID847 | MGPPMLQEISNLFLILLMMGAIFTLAALKESLSTCIPAIVCLXXLLLLNVGQLLA | 2566 | -55 through -1 |
| ID848 | MXXFTDPSSVNEKKRREERERQNIVLWRQPLITIQYFSLEILVILKEWTSKLWHRXXIVVXFLLLLAXLIA | 2567 | -71 through -1 |
| ID849 | MPLLRGLLMXQVLCA | 2568 | -15 through -1 |
| ID850 | MKLLSLVAVVGCLLVPPAEA | 2569 | -20 through -1 |
| ID851 | MPALLPVASRLLLLPRVLLTMASG | 2570 | -24 through -1 |
| ID852 | MCLLLGATGVGKTLLVKRLQEVSSRDGKGDLGEPPPTRPTVGTNLTDIVAQRKITIRELGGCMGPIWSSYYGNCRSLLFVMDASDPTQLSAXXVQLLGLLSAEQLAEA | 2571 | -108 through -1 |
| ID853 | MELPAVNLESDSPRSLAADNLGLHCIRLLCLGQLHHPGLG | 2572 | -41 through -1 |
| ID854 | MAFLRKVYSILSLQVLLTTVTSTVFLYPESVRTFVHESPALILLFALGSLG | 2573 | -51 through -1 |
| ID855 | MYTYGNKQHNSPTWDDPTLAIALAANAWA | 2574 | -29 through -1 |
| ID856 | MQQIFIQQCRELNFWSREPWILVLALPLTVWP | 2575 | -32 through -1 |
| ID857 | MKAVLLALLMAGLAL | 2576 | -15 through -1 |
| ID858 | MGLQACLLGLFALILS | 2577 | -16 through -1 |
| ID859 | MRPGQVSLLGPDAVSVLGSGLGLSPGTSS | 2578 | -29 through -1 |
| ID860 | MINPSVPSKSNSHPFLSTVMFTSASLLLPMSTG | 2579 | -33 through -1 |
| ID861 | MSEKEXNFPPLPKFIPVKPCFYQNFSDEIPVEHQVLVKRIYRLWMFYCATLGVNLIACLAWWIGGGSG | 2580 | -68 through -1 |
| ID862 | MNPTKLIIKTILRLYFFLQLAHS | 2581 | -23 through -1 |
| ID863 | MASSSPDSPCSXXCFVSVPPASA | 2582 | -23 through -1 |
| ID864 | MXPVLAALAHVLCPYMAPGLCREPIRXLIAXILEPPGAMA | 2583 | -39 through -1 |
| ID865 | MNNLNDPPNWNIRPNSRADGGDGSRWNYALLVPMLGLAAFRWIWS | 2584 | -45 through -1 |
| ID866 | MLLLFLAALCSLFFFLSLQ | 2585 | -19 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID867 | MLFLGKVLIVCSTGLAGIMLLNYQQDYTVWVLPLIIVCLFAFLVAHC | 2586 | -47 through -1 |
| ID868 | MQGIPILTPVTTQSIAISIVLTVQGLLLLVHSFWFTVC | 2587 | -38 through -1 |
| ID869 | MQNFCHHLAICTVILFCVLLSLRPHTS | 2588 | -27 through -1 |
| ID870 | MPSFSKDLLTVPKLGTGHXXGKGSYDXALXLLLKCLMSNVVPECTMASSNTVLMRLVASAYSIA | 2589 | -64 through -1 |
| ID871 | MRGAHLTALEMLXAFASHIXA | 2590 | -21 through -1 |
| ID872 | MEVGLPAITLFLTSASSPVATTMDQEPVGGVERGEAVAASGXAAAAAFGESAGQMSNERGFENVELGVIGKKKKKVPRRVIHFVSGETMEEYSTDEDXVDGLEKXMFCLLLIRQNLPGVPTYGFTCFGLLHQLSQCVTS | 2591 | -139 through -1 |
| ID873 | MKELERQQKEVEERPEKDFTEKGSRNNPGLSAATLASLGGTSS | 2592 | -43 through -1 |
| ID874 | MSMGFMMLVLVILCIVTVCVT | 2593 | -21 through -1 |
| ID875 | MMELXLKXXTKXEXESACTEAYSQSDEQYACHLGCQNQLPFAELRQEQLMSLMPKMHLLFPLTIVRSFWS | 2594 | -70 through -1 |
| ID876 | MVSNASETSCLGLILLFASHLINQ | 2595 | -24 through -1 |
| ID877 | MPRKRKCDLRAVRVGLLLGGGGVYGSRPRFTPPGCRALSPWRVXQRRRCEMSTMFADTLLIVFISVCTALLA | 2596 | -73 through -1 |
| ID878 | MGMWSIGAGALGAAALALLLANT | 2597 | -23 through -1 |
| ID879 | MDVAFLEXLIKDDIERGRLPLLIVANAGTAA | 2598 | -31 through -1 |
| ID880 | MRTLFNLLMLALACSP | 2599 | -16 through -1 |
| ID881 | MNAQPGLXLDCTTRFLTXGQFICLQWALPHSEA | 2600 | -33 through -1 |
| ID882 | MGKEWGWQEMENGGAAPAWGAGPPVHPAPPPVEKTLSWGCGFGLHSGPGGSGGGVGLCRLLCLVRLFCC | 2601 | -69 through -1 |
| ID883 | MAAPSGGWNGVGASLWAALLLFATVRLSA | 2602 | -29 through -1 |
| ID884 | MIAIYGKNFCVSAKNAFMLLMRNIVRVVVLDKVTDLLLFFGKLLVVGG | 2603 | -48 through -1 |
| ID885 | MERNCKGSFGVIKEGDTDTXETKARRTVWEPRGRYSFRXTPRPAYPVEQCGFARRALELLEIRKHSPEVCEPPNIPVTSVLELIVASVCQS | 2604 | -91 through -1 |
| ID886 | MFVEYRKQLKLLLDRLAQVSPELLLASVRRVFSSTLQNWQTRFMEVEVAIRLLYMLAEEALPVSHG | 2605 | -66 through -1 |
| ID887 | MLLGTSNIIIFLIQWHGSVFQ | 2606 | -21 through -1 |
| ID888 | MXNRFATAFVXACVLSLIST | 2607 | -20 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID889 | MSLTSGFLRVSQG | 2608 | -13 through -1 |
| ID890 | MANFKGHALPGSFFLIIGLCWSVKYPLKYFSHTRKNSPLHYYQRLEIVEAAIRTLFSVTGILA | 2609 | -63 through -1 |
| ID891 | MQDTGSVVTPLHWFGFGYAALVASGGIIGYVKAGSVPSLAAGLLFGSLAGLGA | 2610 | -52 through -1 |
| ID892 | MEXGLKSADPRDGTGYTXXXXYCCALLTSLXCIWG | 2611 | -35 through -1 |
| ID893 | MASPSRRLQTKPVITCFKSVLLIYTFIFWITGVILLAVGIWG | 2612 | -42 through -1 |
| ID894 | MFSRELAPTRIGGASSGSRSGGTLISTAPLTTRVLNPTAQCFCLDCTLRRMQTHLSVSLLPCAGAWS | 2613 | -67 through -1 |
| ID895 | MSMAVETFGFFMATVGLLMLGVTLPNSYW | 2614 | -29 through -1 |
| ID896 | MEKIPVSXFLXLXXLSXXWP | 2615 | -20 through -1 |
| ID897 | MHSAEEPLXLAALRGARGHLPCCSRHHVGSLAPASVPAPGACLWVCEWETLLPGLILERPLVPSAEA | 2616 | -67 through -1 |
| ID898 | MAGQFRSYVWDPLLILSQIVLMQTVYYGSLGLWLALVDGLVRX | 2617 | -43 through -1 |
| ID899 | MAPKVFRQYWDIPDGTDCHRKAYSTTSIASVAGLTAAAYRVTLNPPGTFLEGVAKVGQYTFTAAAVGAVFGLTTCISA | 2618 | -78 through -1 |
| ID900 | MAAAAWLQVLPVILLLG | 2619 | -18 through -1 |
| ID901 | MEIYFIFCIIVPIAAATVYKSWCLLLILDMNVLYTDA | 2620 | -37 through -1 |
| ID902 | MSRYTSPVNPAVFPHLTVVLLAIGMFFTAWF | 2621 | -31 through -1 |
| ID903 | MRLAAEAHPGRTHTLFRRLKPFIMLSSSLPLLIWL | 2622 | -35 through -1 |
| ID904 | MLEHLXSLPTQMDYKGQKLAXQMFQGIILFSAIVGFIYG | 2623 | -39 through -1 |
| ID905 | MEYSKVLFCSFSNVLG | 2624 | -16 through -1 |
| ID906 | MASKIGSRRWMLQLIMQLGSVLLTRC | 2625 | -26 through -1 |
| ID907 | MEHYRKAGSVELLPAPSPMPQLPPDTLEMRVRDGSKIRNLLGLALGRLEGGSA | 2626 | -52 through -1 |
| ID908 | MNALMVLFNVTVVLIALTCLDGTTVS | 2627 | -26 through -1 |
| ID909 | MNWSIFEGLLSGVNKYSTAFGRIWLSLVFIFRVLVYLVTAERVWS | 2628 | -45 through -1 |
| ID910 | MIISLFIYIFXTCSNT | 2629 | -16 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID911 | MPRLNSLSALAELAVG | 2630 | -16 through -1 |
| ID912 | MTAGTLRTWLCCAGSWA | 2631 | -17 through -1 |
| ID913 | MLGRPCFHSPQRLLVILCVSVKAG | 2632 | -24 through -1 |
| ID914 | MDEARDNACNDMGKMLQFVLPVATQIQQ | 2633 | -28 through -1 |
| ID915 | MSPISIRELCALGSAPSSMWA | 2634 | -21 through -1 |
| ID916 | MTDLLSASPWALT | 2635 | -13 through -1 |
| ID917 | MSWSGLLHGLNTSLTCGPALVPRLWA | 2636 | -26 through -1 |
| ID918 | MADVINVSVNLEAFSQAISAIQA | 2637 | -23 through -1 |
| ID919 | MNVIDNVRDMAAAGLHSNVRLLSSLLLTMSNN | 2638 | -32 through -1 |
| ID920 | MTSACLAWTAVRPSAC | 2639 | -16 through -1 |
| ID921 | MNGSRTLTHSISDGQLQGGQSNSELFQQEXQTAPAQVPQGFNVFGMSSSSGASNS | 2640 | -55 through -1 |
| ID922 | MLGFFLFLSFVLMYDG | 2641 | -16 through -1 |
| ID923 | MMEERANLMHNMKLSIKVLLQSALSLG | 2642 | -27 through -1 |
| ID924 | MELEXIVSAALLAFVQT | 2643 | -17 through -1 |
| ID925 | MLRQIIGQAKKHPSLIPLFXFIGTGA | 2644 | -26 through -1 |
| ID926 | MVKETQYYDILGVKPSASPERSRPIGSWRSSTTRTRTRMRARSLNSYPRHMKCFQIQRKGMFMTKAESRQXKKEAQAAPASLHPWTSLTCSLVVVDG | 2645 | -98 through -1 |
| ID927 | MANLFIRKMVNPLLYLSRHTVKPRALSTXLFGSIRG | 2646 | -36 through -1 |
| ID928 | MAAAASRGXGAKLGLRXIRIHLCQRSPGSQG | 2647 | -32 through -1 |
| ID929 | MFPSCYLCYSLCGSILLSIFSAYNRLSLMLRIALTLIPSMLSRA | 2648 | -44 through -1 |
| ID930 | MSTQXGLSMHAHPQAYTPFIYLHARKRRGEIGDADSRFNDRYAHKSAQLXFLYFVCCIFQ | 2649 | -60 through -1 |
| ID931 | MKHFQDLPSSCSCSLISFTRG | 2650 | -21 through -1 |
| ID932 | MSQRSLCMDTSLDVYRXLIELNYLGTVSLTKCVLPHMIERKXXKIVTVNSILGIISVPLSIG | 2651 | -62 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID933 | MGSGSRLSKELLAEYQDLTFLTKQEILLAHRRFCELLPQEQRXXSRHFGHKCPSSRFSAFQSSRPTPSRSESAGSSPHPQPKTALALRTSWISSVCS | 2652 | −98 through −1 |
| ID934 | MWRLLARASAPLLRVPLSDSWALLPASA | 2653 | −28 through −1 |
| ID935 | MADHVQSLAQLENLCKQLYETTDTXXRSSXAEKALVEFTNSPDCLSKCQLLERGSSSYSQLLAATCLTKLVSRTNNPLPLEQRIDIRNYVLNXLATRPKLATFVTQALIQXYA | 2654 | −114 through −1 |
| ID936 | MAVHGLTVPLIVMSVFWGFVGFLVPWFIPKGPNRGVIITMLVTCSVCCYLFWLIA | 2655 | −55 through −1 |
| ID937 | MSTGQLYRMEDIGRFHSQQPGSLTPSSPTVGEIIYNNTRNTLGWIGGILMGSFQGTIA | 2656 | −58 through −1 |
| ID938 | MGWQRWCFHLQAEASA | 2657 | −17 through −1 |
| ID939 | MSVIFFACVVRVRDG | 2658 | −15 through −1 |
| ID940 | MAVTALAAXTWLGVWG | 2659 | −16 through −1 |
| ID941 | MSLSAFTLFLALIGGTSG | 2660 | −18 through −1 |
| ID942 | MSLSAFTLFLALIGGTSG | 2661 | −18 through −1 |
| ID943 | MSLSAFTLFLALIGGTSG | 2662 | −18 through −1 |
| ID944 | MVELMFPLLLLLPFLLYMA | 2663 | −20 through −1 |
| ID945 | MWLLYLLVPALFCRA | 2664 | −15 through −1 |
| ID946 | MKQILHPALETTANTLFPVLLFLVAGLLPSFP | 2665 | −32 through −1 |
| ID947 | MLKALFLTMLTLALVKS | 2666 | −17 through −1 |
| ID948 | MEKNPLAAPLLIWFHLDCVSS | 2667 | −22 through −1 |
| ID949 | MRVVTIVILLCFCKA | 2668 | −15 through −1 |
| ID950 | MDQFPESVTENFFEYDDLAEACYIGDIVVFGTVFLSIFYSVIFAIGLVGNLLVVFALTNSKKPKSVTDIYLLNLALSDLLFVATLPFWTHY | 2669 | −90 through −1 |
| ID951 | MGEASPPAPARRELLVLLLLSTLIVIPSAA | 2670 | −30 through −1 |
| ID952 | MAPQTLLPVLVLCVLLLQAQG | 2671 | −21 through −1 |
| ID953 | MWTLKSSLVLLLCLTCSYA | 2672 | −19 through −1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID954 | MLPLLLLPLLWGGSLQ | 2673 | -16 through -1 |
| ID955 | METGALRRPQLLPLLLLLCGPSQDQC | 2674 | -26 through -1 |
| ID956 | MERIVLTLCTLPLAVA | 2675 | -16 through -1 |
| ID957 | MMLPQWLLLLFLLFFFLFLLTRG | 2676 | -23 through -1 |
| ID958 | MKPVLPLQXLVVFCLALQLVPG | 2677 | -22 through -1 |
| ID959 | MFRQRQETAQRSTQSCRCPRDGLFFSLFSAPLASA | 2678 | -35 through -1 |
| ID960 | MGSSACEIAVGTKRLLLALPLALVLG | 2679 | -26 through -1 |
| ID961 | MSNQRLPLIFSLLFICFFGESFC | 2680 | -23 through -1 |
| ID962 | MLWFLSFLLALLSLNC | 2681 | -16 through -1 |
| ID963 | MLXISLEIXSFICCVIVLISLSWT | 2682 | -24 through -1 |
| ID964 | MVFRNCILFILTFFSHTFC | 2683 | -19 through -1 |
| ID965 | MLAACPLSPGCQS | 2684 | -13 through -1 |
| ID966 | MAWSPLFLTLITHCTVSWA | 2685 | -19 through -1 |
| ID967 | MLKSVLVSLCSWSPPLTS | 2686 | -18 through -1 |
| ID968 | MTSKXILVSFILAALSLSTTFS | 2687 | -22 through -1 |
| ID969 | MKSLSLXLAVXLGLATAVSA | 2688 | -20 through -1 |
| ID970 | MWAMESGHLLWALLFMQSLWP | 2689 | -21 through -1 |
| ID971 | MAQTWAXLLVMGSLPSASWS | 2690 | -20 through -1 |
| ID972 | MKCGFLAYLLITLLYVWPVINA | 2691 | -22 through -1 |
| ID973 | MRKPAAGFLPSLLKVLLLPLAPAAA | 2692 | -25 through -1 |
| ID974 | MRQSLLFLTSVVPFVLA | 2693 | -17 through -1 |
| ID975 | MELSQMSELMGLSVLLGLLALMATA | 2694 | -25 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID976 | MQDAPLSCLSPIKWSSVSSADSTEKSASAAGTRNLPPQFCLRQALRMKAAGILTLIGCLVTGVES | 2695 | -65 through -1 |
| ID977 | MALAFCLCMAEAILLFSPEHSLFFFCSRKARIRLHWAGQTLAILCAALGLGFIISSRTRSELPHLVSWHSWVGALTLLATAVQALCGLCLLCPRAA | 2696 | -96 through -1 |
| ID978 | MLRPPTCFPSXRVXGXKQLPQEIIXLVWSPXRDXIXLANTAGEVLLHRLASFHRVWS | 2697 | -57 through -1 |
| ID979 | MFMVLEVVVSRVTSSLAMLSDSFHMLSDVLALVVALVAERFA | 2698 | -42 through -1 |
| ID980 | MENQLWHNTVRCCNQYQESPHDAEDILLLLLGLIVLVNI | 2699 | -39 through -1 |
| ID981 | MLSXKITLLTLSPNSVCC | 2700 | -18 through -1 |
| ID982 | MEGPRGWLVLCVLAISLA | 2701 | -18 through -1 |
| ID983 | MKSLLFTLAVFMLLAQLVSG | 2702 | -20 through -1 |
| ID984 | MLKLILFSLLISIVC | 2703 | -16 through -1 |
| ID985 | MTPWCLACLGRRPLASLQWSLTLAWC | 2704 | -26 through -1 |
| ID986 | MTMRHNWTPDLSPLWVLLLCAHVVTL | 2705 | -26 through -1 |
| ID987 | MTGNNRDLFCATLSCMPATS | 2706 | -20 through -1 |
| ID988 | MTMRHNWTPDLSPLWVLLLCAHVVTL | 2707 | -26 through -1 |
| ID989 | MKPLLETLYLLGMLVPGGLG | 2708 | -20 through -1 |
| ID990 | MNQAPRLRAVCLWTLTSAAMSRGDNCTDLLALGIPSITQAWGLWVLLGAVTLLFLISLAAHLSQ | 2709 | -65 through -1 |
| ID991 | MHRQISFLLLRKPRKNWFCQNHVNLRKRYLLSILSSLTMVIC | 2710 | -42 through -1 |
| ID992 | MKQWLCWVLRLEGRQGLGVGEPRGLRLCLGALSAXTFVSFLHA | 2711 | -43 through -1 |
| ID993 | MRLGLCFWVPHRGEMSFSSHYSRGTWYQWDLSLLMLTLISWFRMCLPAVSTVELLFLFPILFIRS | 2712 | -66 through -1 |
| ID994 | MDFWEEYRRGDVPFSWCPIRSYLMSVCPVTGKVNLNHLVKVASARFLHQVTIFPFLYSVKANYCFLNFDVPQYAWEIHSFAAPSILIVIIVITITSACSA | 2713 | -101 through -1 |
| ID995 | MSTSSSSWDNLLESLSLSTVWNWIQA | 2714 | -27 through -1 |
| ID996 | MVFATIGFSLKSGLALGSAGLLWCLA | 2715 | -26 through -1 |
| ID997 | MVLLSGSVSVGVC | 2716 | -14 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID998 | MCSQKRAVSNQGLMDLGLCXLCXVXNVFA | 2717 | -29 through -1 |
| ID999 | MLIVLTLHSPSCDT | 2718 | -14 through -1 |
| ID1000 | MTRLCLPRPEAREDPIPVPPRGLGAGESGSPVRPPVSTWGPSWAQLLDSVLMLGALGLTIQ | 2719 | -62 through -1 |
| ID1001 | MVLTCLFLSLISTYP | 2720 | -15 through -1 |
| ID1002 | MLIPVFSFSLQLLSSSST | 2721 | -18 through -1 |
| ID1003 | MAAAXLSGPSAGSAAGVPGGTGGLSAVSSGPRLRLLLESVSGLLQP | 2722 | -47 through -1 |
| ID1004 | MHNWLFLFVFTFCNC | 2723 | -15 through -1 |
| ID1005 | MHVECFYFLSTALGSQA | 2724 | -17 through -1 |
| ID1006 | MSPGSALALLWSLPASDLG | 2725 | -19 through -1 |
| ID1007 | MALALGSIPSSIA | 2726 | -13 through -1 |
| ID1008 | MLAFLFCTLFSLVVHP | 2727 | -16 through -1 |
| ID1009 | MAQMPLTGSYQDLEYFLECMFLHLLYTLQTISSLSG | 2728 | -36 through -1 |
| ID1010 | MALLMGLWVRTVLQG | 2729 | -15 through -1 |
| ID1011 | MINHLYLAILIXSLKLITG | 2730 | -19 through -1 |
| ID1012 | MGRQGTLEIEGILCVITWLEANLGKQKDENHYYKKLSLLYLCSFPLPGTS | 2731 | -50 through -1 |
| ID1013 | MELTNKQTGTDRHEQVLRRVKQDKRISAWWCVLLEWSQG | 2732 | -39 through -1 |
| ID1014 | MAKRQNPTSVLGLLFSISDTWA | 2733 | -22 through -1 |
| ID1015 | MNVLPFSYYYILFCLSLQIFRVSLA | 2734 | -25 through -1 |
| ID1016 | MKCLKVNPFLFLVFNFFSYISXFLSPVCG | 2735 | -29 through -1 |
| ID1017 | MSWTVPVVRASQRVSSVGANXLCLGMALCPRQA | 2736 | -33 through -1 |
| ID1018 | MGFLXLMTLTTHVHS | 2737 | -15 through -1 |
| ID1019 | MLFRVLLIAQLFLGSG | 2738 | -16 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1020 | MRVPEDLASKILLPGCAPGSLPLSTSAPPLRG | 2739 | -32 through -1 |
| ID1021 | MFPHXETQVKCFWQGLRRSDLCLCQCILARA | 2740 | -31 through -1 |
| ID1022 | MKSLLFTLAVFMXLAQLVSG | 2741 | -20 through -1 |
| ID1023 | MHLYSCSCMRLLNVACCIPFSSS | 2742 | -23 through -1 |
| ID1024 | MRAPLVLSPLSYQCSS | 2743 | -16 through -1 |
| ID1025 | MQVPHLRVWTQVXDTFIGYRNLGFTSMCILFHCLLS | 2744 | -36 through -1 |
| ID1026 | MQKLMAVPMITRAQGGDTCTRQILWLMHQSFQKSNS | 2745 | -36 through -1 |
| ID1027 | MCXAGFXDHPRAARHARTSRHPLPWVCVSQXPAHRSLCLWPACLC | 2746 | -45 through -1 |
| ID1028 | MTSKPILVSFILAALSLS | 2747 | -18 through -1 |
| ID1029 | MHLLIFILTVHHTPS | 2748 | -15 through -1 |
| ID1030 | MLSSSLMVQLISQVYS | 2749 | -16 through -1 |
| ID1031 | MFSYILCMLFCLFS | 2750 | -14 through -1 |
| ID1032 | MLFLYYVTLAFSLLVLSES | 2751 | -19 through -1 |
| ID1033 | MLLSGLWLSSVKEC | 2752 | -14 through -1 |
| ID1034 | MVAFSVFCFSWLMSSSSP | 2753 | -18 through -1 |
| ID1035 | MVPLALGIGPPGCLQG | 2754 | -16 through -1 |
| ID1036 | MNLCMGVLLKVGTSRRCLCLLWFCTAMRPGGA | 2755 | -32 through -1 |
| ID1037 | MSLAKSLFLRVARG | 2756 | -14 through -1 |
| ID1038 | MRLPPFLPSATLLLSAES | 2757 | -18 through -1 |
| ID1039 | MSDRKRTKFSYVQLPCPISLLPRSFKRGQIPGPSAPPLLLLREELVTG | 2758 | -49 through -1 |
| ID1040 | MTPLGSGPPREASIAQVRGFSRTFFRVAFCFFPAFLVXVXS | 2759 | -41 through -1 |
| ID1041 | MRCSALFPLLSLLSC | 2760 | -15 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1042 | MLYDQYYLIISLLKLCSPCFI | 2761 | -21 through -1 |
| ID1043 | MANCFLSHKSQTILISKPALTQSHFTSPAGLFLTVEKSHLLTRLFFHWLSLVLCSFLSLRFCTLS | 2762 | -65 through -1 |
| ID1044 | MHGAGLTYLLFLPDWAAV | 2763 | -18 through -1 |
| ID1045 | MCCLSATLAFSGSFL | 2764 | -15 through -1 |
| ID1046 | MAELDLMAPGPLPRATAQPPAPLSPDSGLRGLLLQEALG | 2765 | -39 through -1 |
| ID1047 | MTLTHGNNILHLANFFLVACPLFGVCLX | 2766 | -28 through -1 |
| ID1048 | MVLRWLPWPRGSHS | 2767 | -14 through -1 |
| ID1049 | MKARLSGNLICFSFLGTLFHKSNS | 2768 | -24 through -1 |
| ID1050 | MSHVCLVPQTPSLCLG | 2769 | -16 through -1 |
| ID1051 | MYPASFVFKIPSTAYVVLTSVNLFIGING | 2770 | -29 through -1 |
| ID1052 | MSSSRKDHLGAXAQSPSRSSLWVTAPLVSA | 2771 | -30 through -1 |
| ID1053 | MASPAAATYLVQSSACCPA | 2772 | -19 through -1 |
| ID1054 | MNAAINTGPAPAVTKTETEVQNPDVLWDLDIPEARSHADQDSNPXAEFALLPCNLHXSWLHS | 2773 | -61 through -1 |
| ID1055 | MINLLVGNCIYLLGAIRASCMCRXMSFAKFGIFLVIFCSESFS | 2774 | -43 through -1 |
| ID1056 | MLCCGPLRFLLRDPGCLLA | 2775 | -19 through -1 |
| ID1057 | MRKTSFILLRMTVLPTLWT | 2776 | -19 through -1 |
| ID1058 | MWWKPAPEGVRVGLVLVXRALC | 2777 | -23 through -1 |
| ID1059 | MFNFLLGNSSCVYQ | 2778 | -14 through -1 |
| ID1060 | MKRGAFSNLNDSQLSASFLQPSLQANCPALDPAVSLSAPAFA | 2779 | -42 through -1 |
| ID1061 | MKSAKLGFLLRFFIFCSLNTLLLG | 2780 | -24 through -1 |
| ID1062 | MDILFPLHSVIGSHP | 2781 | -15 through -1 |
| ID1063 | MLKVFRAXHPKICHFGILILLSQRQWS | 2782 | -27 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1064 | MLVRNARRGSRGRSPWWRAGCLXWRKLAASWTLS | 2783 | −34 through −1 |
| ID1065 | MTKGHHHQHPLHPHPLFTLGLGYPIPTRL | 2784 | −29 through −1 |
| ID1066 | MTYHXIQFSERLHILFIVCLARG | 2785 | −23 through −1 |
| ID1067 | MSQPPLCSPPWKPLVKVSRNLKIRMSIPWPLSVLIYCGLSQPLTLG | 2786 | −46 through −1 |
| ID1068 | MFRSLTIAFFRDAMGFLLMFDLTSQ | 2787 | −25 through −1 |
| ID1069 | MVLTTLPLPSANSPVNMPTTGPNSLSYASSALSPCLX | 2788 | −37 through −1 |
| ID1070 | MQRNATFIHLQLAIRPSLLPTLPWLPSTRL | 2789 | −30 through −1 |
| ID1071 | MNILFCFHSFHPLFQ | 2790 | −15 through −1 |
| ID1072 | MLTNRNYFNFLFLVQLCILA | 2791 | −20 through −1 |
| ID1073 | MKLNPGQVPTWEEALCRFVGMQPCTA | 2792 | −26 through −1 |
| ID1074 | MLAGFRRSAPASQSLCLNLCPCSSSLL | 2793 | −27 through −1 |
| ID1075 | MKEGASFYLLFFLNDVPP | 2794 | −18 through −1 |
| ID1076 | MGLECCCPPHNLRVYIETLLLKLSSQSRT | 2795 | −29 through −1 |
| ID1077 | MQLCPFTSVLSIAASLLQCRL | 2796 | −21 through −1 |
| ID1078 | MDVTCCFDAVEGSDFRVCCHGCVSWLCLQMLQLLFKLNSTWCRA | 2797 | −44 through −1 |
| ID1079 | MRQGPGAPLHCFCFTLFSYSSS | 2798 | −22 through −1 |
| ID1080 | MHITLLGIWLTXRLQ | 2799 | −15 through −1 |
| ID1081 | MLYGSWVCLLSAGTAFE | 2800 | −17 through −1 |
| ID1082 | MLFFPLLSFRFLPSESLLKXXXXFLLGRRVVG | 2801 | −32 through −1 |
| ID1083 | MPVWAILGCWGTLSRG | 2802 | −16 through −1 |
| ID1084 | MGMSGKKHFPLSWDHIQGSTEATSQGILCGSLPGPSLC | 2803 | −38 through −1 |
| ID1085 | MASKILLNVQEEVTCPICLELLTEPLSLDCGHSLCRA | 2804 | −37 through −1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1086 | MYMVCLFFRLIFS | 2805 | -14 through -1 |
| ID1087 | MGAGGXREIRAAAASWLRAAEHSKLAGLMSPGLVPA | 2806 | -36 through -1 |
| ID1088 | MGSKCCKGGPDEDAVERQRRQKLLLAQLHHRKRVKAAGQIQAWWRGVLVRRTLLVAALRA | 2807 | -60 through -1 |
| ID1089 | MQQGHPHLSAGTLSIHSWQLLTSAQP | 2808 | -26 through -1 |
| ID1090 | MSRYEXGSSLLPPDHFSVYSFKXXSFFEAYSISDYATCCLSLFQWCAV | 2809 | -49 through -1 |
| ID1091 | MIYFIKINNKLLLLHHYLLLFITT | 2810 | -24 through -1 |
| ID1092 | MELLYLKVKRGQKDLSWALCLSQSGYY | 2811 | -27 through -1 |
| ID1093 | MTLAVTLSALGATG | 2812 | -14 through -1 |
| ID1094 | MLGPPLQPGSHGKVLAPQGSSGLTPPPCRCLITLPRSCRP | 2813 | -41 through -1 |
| ID1095 | MGNVCSCCLRARYQQLXLILVHFPAYS | 2814 | -27 through -1 |
| ID1096 | MLYGLGSGPRCVISCIHGVWC | 2815 | -21 through -1 |
| ID1097 | MHRIMTLIHLKALQQLQNKIHVPRMLPGPVTPLDSCPPSAHS | 2816 | -42 through -1 |
| ID1098 | MLFLVLFYSAIFL | 2817 | -13 through -1 |
| ID1099 | MVSLCVAALFPLQA | 2818 | -14 through -1 |
| ID1100 | MSSNLFYIPSILTLLA | 2819 | -17 through -1 |
| ID1101 | MGLLRKCFPVMLGGNTHIQITCIKQFILCLGTCRG | 2820 | -35 through -1 |
| ID1102 | MMLPLFCSPWESGG | 2821 | -14 through -1 |
| ID1103 | MAKLLSDLSVDSARC | 2822 | -15 through -1 |
| ID1104 | MCGYWVCWGHLLPARVST | 2823 | -18 through -1 |
| ID1105 | MKLSCAGCADTAILGLSTFLNLLS | 2824 | -24 through -1 |
| ID1106 | MIPFSGTVFSLGSCPAGPLSA | 2825 | -21 through -1 |
| ID1107 | MIPSSQPRFXNPACKQTVLLXDPAVSLSAPAFASA | 2826 | -35 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1108 | MAPTFLLISDSFLTS | 2827 | -15 through -1 |
| ID1109 | MISLIVLSLLGLGIKIQWCLS | 2828 | -19 through -1 |
| ID1110 | MACDSFLKDALPQELSQLXFLFPLVDMREDLLYFNTFLPRKVA | 2829 | -43 through -1 |
| ID1111 | MLLLNENLKAEIQKNEAQGSCILFLFCFESQNNRSKSIFPFLILHFFPQQIRK | 2830 | -53 through -1 |
| ID1112 | MISKYVHYSLTDLLLPFTFLSLKAFL | 2831 | -26 through -1 |
| ID1113 | MARTMGVPRACKAFCSLLSSFCALHFG | 2832 | -27 through -1 |
| ID1114 | MLICFLLPHHRLQEA | 2833 | -15 through -1 |
| ID1115 | MQDYVSHAVRRHCQCFFVCFSPKIYG | 2834 | -26 through -1 |
| ID1116 | MEFAHAAECVSFALNETHVLLNLALSHFNNC | 2835 | -31 through -1 |
| ID1117 | MGNQGFPYLSPSLSVQDLLAASWLPRDAPC | 2836 | -30 through -1 |
| ID1118 | MKYQMVSGSAQLASPLLPGATP | 2837 | -22 through -1 |
| ID1119 | MGPSTPLLILFLLSWSGPLQG | 2838 | -21 through -1 |
| ID1120 | MASLGHILVFCVGLLTMAKA | 2839 | -20 through -1 |
| ID1121 | MSGSSLPSALALSLLLVSGSLLP | 2840 | -23 through -1 |
| ID1122 | MMEVVVGNGVVALRGIPPRTSRKSSRKTRFCGERGSKQSGKCSPVGLAVVSLGGSRG | 2841 | -57 through -1 |
| ID1123 | MARCFSLVLLLTSIWT | 2842 | -16 through -1 |
| ID1124 | MGSRKCGGCLSCLLIPLALWS | 2843 | -21 through -1 |
| ID1125 | MGSRKCGGCLSCLLIPLALWS | 2844 | -21 through -1 |
| ID1126 | MMVMILFGVSFVFLTHC | 2845 | -17 through -1 |
| ID1127 | MSNTHTVLVSLPHPHPALT | 2846 | -19 through -1 |
| ID1128 | MXVYRLQTQEKPNTTVQVPAFLQELVDRDNSKFEEWCIEMAEMRXKVWIKEKQNTKRLRSCTKGYLLELSPMSLSLWNGCKSGWMNQQXPNLLIITLACVPMTSFT | 2847 | -106 through -1 |
| ID1129 | MFPVLGWILIAVVIIILLIFT | 2848 | -21 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1130 | MFSCCISVCLCPCLNKGQS | 2849 | -19 through -1 |
| ID1131 | MRLCLIMYCSFGTLSHLTYLLLLSPIKYP | 2850 | -29 through -1 |
| ID1132 | MGKGMVANLILGLLLLALLLPVQVSS | 2851 | -26 through -1 |
| ID1133 | MGSSGLLSLLVLFVLLANVQG | 2852 | -21 through -1 |
| ID1134 | MVLGGCPVSYLLLCGQAALLLGNLLLHCVSRSHS | 2853 | -35 through -1 |
| ID1135 | METGRLLSLSSLPIVLLG | 2854 | -18 through -1 |
| ID1136 | MAASLGQVLALVLVAALWG | 2855 | -19 through -1 |
| ID1137 | MHIKSIILEGFKSYAQRTEVNGFDPLFNAITGLNGSGKSNILDSICFLLGISNLSQVRA | 2856 | -59 through -1 |
| ID1138 | MSPSPRWGFLCVLFTAVHP | 2857 | -19 through -1 |
| ID1139 | MCSLLYPLVTFFLLCLCIAYWAST | 2858 | -24 through -1 |
| ID1140 | MLPFLFFSTLFSSIFT | 2859 | -16 through -1 |
| ID1141 | MVALNLIIVPCCAA | 2860 | -14 through -1 |
| ID1142 | MAARGVIAPVGESLRYAEYLQPSAKRPDADVDQQRLVRSLIAVGLGVAALAFA | 2861 | -53 through -1 |
| ID1143 | MIKLKLLSLLRPSLC | 2862 | -15 through -1 |
| ID1144 | MPSVNSAGLCVLQLTTAVTS | 2863 | -20 through -1 |
| ID1145 | MMLGLHFALFLLVSXYMIRS | 2864 | -20 through -1 |
| ID1146 | MALLLSVLRVLLG | 2865 | -13 through -1 |
| ID1147 | MLKSLWLSLVAWHWGEA | 2866 | -17 through -1 |
| ID1148 | MGIVTWLLXSFMSSA | 2867 | -15 through -1 |
| ID1149 | MAGIKALISLSFGGAIGLMFLMLGCALP | 2868 | -28 through -1 |
| ID1150 | MKKQKHQKLWCISVKLVTLSVPTSLA | 2869 | -26 through -1 |
| ID1151 | MDGIPMSMKNEMPISQLLMIIAPSLGFVLFALFVAFLLRG | 2870 | -40 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1152 | MGGFLHLPALSSSCLWTFPPMCVRIFSVPLPILTPKTINLIPVLAICSCLPGPGPA | 2871 | -57 through -1 |
| ID1153 | MSPSPRWGFLCVLFTAVHP | 2872 | -19 through -1 |
| ID1154 | MTSQPVPNETIIVLPSNVINFSQAEKPEPTNQGQDSLKKHLHAEXKVIGTIQILCGMMVLSLGIILASASFSPNFT | 2873 | -76 through -1 |
| ID1155 | MRALENDFFNSPPRKTVRFGGTVTEVLLKYKKGETNDFELLKNQLLDPDIKDDQIINWLLEFRSSVMYLTKDFEQLISILRLPWLNRSQT | 2874 | -91 through -1 |
| ID1156 | MVFPAKRFCLVPSMEGVRWAFSCGTWLPSRA | 2875 | -31 through -1 |
| ID1157 | MNCFQGTNASALEKDIGPEQFPINEHYFGLVNFGNTCYCNSVLQALYSCRPFRENVLAYKAQQKKKENLLTCLADLFHSIAT | 2876 | -82 through -1 |
| ID1158 | MAAALRVRXXXFGTRA | 2877 | -16 through -1 |
| ID1159 | MKLLTHNLLSSHVRG | 2878 | -15 through -1 |
| ID1160 | MGXFSRRTFCGRSGRSCRGQLVQVSRPEVSAGSLLLPAPQA | 2879 | -41 through -1 |
| ID1161 | MEGGVRLDLSACGETSGVAVSELPASETAALVPEGHGPGLRACALSLPDAPGASG | 2880 | -55 through -1 |
| ID1162 | MTLLSFAALTAAFS | 2881 | -14 through -1 |
| ID1163 | MAAATGDPGLSKLQFAPFSSA | 2882 | -21 through -1 |
| ID1164 | MFTSTGSSGLYKAPLSKSLLLVPSXLS | 2883 | -27 through -1 |
| ID1165 | MTSMTQSLREVIKAMTKARNFERVLGKITLVSAAPGKVIC | 2884 | -40 through -1 |
| ID1166 | MADFGISAGQFVAVVWDKSSPVEALKGLVDKLQALTGNEGRVSVENIKQLLQSAHKESSXDIILSGLVPGSTT | 2885 | -73 through -1 |
| ID1167 | MGILLGLLLLGHLT | 2886 | -14 through -1 |
| ID1168 | MFLTVKLLLGQRCSLKVSG | 2887 | -19 through -1 |
| ID1169 | MNVIDHVRDMAAAGLHSNVRLLSSLLLTMSNN | 2888 | -32 through -1 |
| ID1170 | MGTPSLSILLIGAPESPIPYFPYHSGTGRVLCPLLXAAAAP | 2889 | -41 through -1 |
| ID1171 | MVYHALDSPDDDYHALFVLCLLYAMS | 2890 | -26 through -1 |
| ID1172 | MFIVLSMWLCCGFE | 2891 | -14 through -1 |
| ID1173 | MVVVILSSXVPLAAM | 2892 | -15 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1174 | MLAECSSLLHPSVRG | 2893 | -15 through -1 |
| ID1175 | MQMARLLGLCAWARK | 2894 | -15 through -1 |
| ID1176 | MTPQYLPHGGKYQVLGDYSLAVVFPLHFSDLISVLYLIPKTLT | 2895 | -43 through -1 |
| ID1177 | MVVLRAGKKTFLPPLXRAFACRG | 2896 | -23 through -1 |
| ID1178 | MKREGGAAHLCSDSLPESQQ | 2897 | -20 through -1 |
| ID1179 | MVTCPGPSSGQPLSSMYTAGDRRGAPSLPYSLAACPCGSQG | 2898 | -41 through -1 |
| ID1180 | MQRQLALEVIVTLSETAA | 2899 | -18 through -1 |
| ID1181 | MGDYLLRGYRMLGETCADCGTILLQDKQRKIYCVACQELDSDVDKDNPALNAQAALSQAREHQLASASELPLGSRP | 2900 | -76 through -1 |
| ID1182 | MWLLYLLVPALFCRA | 2901 | -15 through -1 |
| ID1183 | MKLEFTEKNXXSFVLQNLNRQRKREYWDMALSVDNHVFFAHRNVLAAVSPLVRSLIS | 2902 | -58 through -1 |
| ID1184 | MMWRPSVLLLLLLRHGAQG | 2903 | -20 through -1 |
| ID1185 | MGKICKNWVSFLDNVLLILFLYGLCSG | 2904 | -28 through -1 |
| ID1186 | MLTVALLALLCASASGNA | 2905 | -18 through -1 |
| ID1187 | MVLLLCLSCLIFS | 2906 | -13 through -1 |
| ID1188 | MPVPALCLLWALAMVTRPASA | 2907 | -21 through -1 |
| ID1189 | MHLRGSHTYPSCPSSELRLDSLMQHHRQLLPLWVFLPLSLG | 2908 | -41 through -1 |
| ID1190 | MPVPASWPHLPSPFLLMTLLLGGLTG | 2909 | -26 through -1 |
| ID1191 | MAQRCVCVLALVAMLLLVFPTVS | 2910 | -23 through -1 |
| ID1192 | MDYLISFLLLLLLLP | 2911 | -16 through -1 |
| ID1193 | MATTVPDGCRNGLKSKYRLCDKAEAWGIVLETVATAGVVTSVAFMLTLPILVCKVQDSNRRKMLPTQFLFLLGVLGIFGLTFA | 2912 | -84 through -1 |
| ID1194 | MESGLSWLFLVIFIKGVQC | 2913 | -19 through -1 |
| ID1195 | MSGTSVLLHVAFLPGRFG | 2914 | -18 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1196 | MLQGLLPVSLLLSVAVS | 2915 | -17 through -1 |
| ID1197 | MHICHVSLLLQLCSS | 2916 | -15 through -1 |
| ID1198 | MIFADRTHSSAFTLMRSYSLLLCSLLFSFPFLC | 2917 | -33 through -1 |
| ID1199 | MAFLPSWVCVLVGSFSASLA | 2918 | -20 through -1 |
| ID1200 | MFLVSCVICTGSFA | 2919 | -14 through -1 |
| ID1201 | MKKTGDGGTLSTERIGGAALLSLLLKRNKMTLMIPLLLLTPITA | 2920 | -44 through -1 |
| ID1202 | MGFFLPHGISDAXILLAGWCPDTPA | 2921 | -25 through -1 |
| ID1203 | MWLRPGSCWSTREPRRAPRTSASLSSFLGPSAVCTLLSSHPASRC | 2922 | -46 through -1 |
| ID1204 | MSEGMVTLLTFSCLWTDDSFMSXLNVLFLLSLFCRLYHG | 2923 | -39 through -1 |
| ID1205 | MLILGLPLCRPLWI | 2924 | -14 through -1 |
| ID1206 | MYIYFFVLCXLSHFILLVLPCLIFS | 2925 | -25 through -1 |
| ID1207 | MDSRVSSPEKQDKENFVGVNNKRLGVCGWILFSLSFLLVIIT | 2926 | -42 through -1 |
| ID1208 | MCILFCVVLCLSPTSY | 2927 | -16 through -1 |
| ID1209 | MHRGDIETLLCLGSSCCQC | 2928 | -19 through -1 |
| ID1210 | MFLKSGAGLSSCLLPLCWL | 2929 | -19 through -1 |
| ID1211 | MANAIIKKPCAMPAQPHTGNLLMPPLVWVWLGLLPLFS | 2930 | -38 through -1 |
| ID1212 | MSPPPLLQPLLLLLPLLNV | 2931 | -19 through -1 |
| ID1213 | MIPIYQNKSQTDSHCSLSHKGLAFLKVWLILIGLFSLTGLVA | 2932 | -42 through -1 |
| ID1214 | MALPGIHLLSGSTCPGPCSC | 2933 | -20 through -1 |
| ID1215 | MPSETLWEIAKAEVEKRGINGXXGDGAEIALIPLFSTXAFA | 2934 | -41 through -1 |
| ID1216 | MEWLRPSQISFYPGYSKERLRLVLLCMSLTFLALSTL | 2935 | -37 through -1 |
| ID1217 | MKAIIHLTLLALLSVNTG | 2936 | -18 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1218 | MDVSASKPVAESWSPGSLPLALTLSLSTS | 2937 | −29 through −1 |
| ID1219 | MGVRVGVSLRAMCVFIQTALLGLPXAWA | 2938 | −28 through −1 |
| ID1220 | MIISIIPRSFFLLLCIPLTLL | 2939 | −22 through −1 |
| ID1221 | MTMQRSRSSSWTSCNSWTLVLMSPEWALL | 2940 | −29 through −1 |
| ID1222 | MITLPQTSSLLCSLMASISPTLT | 2941 | −23 through −1 |
| ID1223 | MLRTCYVLCSQAGPPSRGWQSLSFDGGAFHLKGTGELTRALLVLRLCAWPPLVTHGLLLQAWS | 2942 | −63 through −1 |
| ID1224 | MICSPFSGFAPCQALGTLGVGCHFFHLALG | 2943 | −30 through −1 |
| ID1225 | MCNPEEALXGLEVFSATLAMVNSLVLQPLLPAAPDPSDPWGRECLRLLQQLHKSSQQLWEVTEESLHSLQERLRYPDSTGLESLLLLRGADRVLQA | 2944 | −98 through −1 |
| ID1226 | MDKLIPSLSSQENRKASHTLHKARNKQHCGGFLLVIHWVMCPSLS | 2945 | −45 through −1 |
| ID1227 | MSXLLPVVLASPPVGHG | 2946 | −17 through −1 |
| ID1228 | MVLLTMIARVADG | 2947 | −13 through −1 |
| ID1229 | MFHIAFSEALPVDIFKTQPNCHEAFSMKAIHITRIRSGLCLLELLFVPLLCFL | 2948 | −53 through −1 |
| ID1230 | MMHCTPSGSAAVSLLTETVLPLAFP | 2949 | −25 through −1 |
| ID1231 | MTRPFWASCSTWATSRISCAFSLASSTA | 2950 | −28 through −1 |
| ID1232 | MVTHLIRGVVLQSCCLIQWPELSFS | 2951 | −26 through −1 |
| ID1233 | MYMWSKLLVAFRVFLGLFS | 2952 | −19 through −1 |
| ID1234 | MSSRNCFFPSFLFGLYSFRAVDS | 2953 | −23 through −1 |
| ID1235 | MYMNTCLYLHVYVLTCSG | 2954 | −18 through −1 |
| ID1236 | MSCRQPTPTQCSLLPNDNRVSTRGGDSAGRHRQVPQVALSASLPQCSLG | 2955 | −49 through −1 |
| ID1237 | MITGCTKPTAGVVVLQGSRA | 2956 | −20 through −1 |
| ID1238 | MGLDLILSFSSSSP | 2957 | −14 through −1 |
| ID1239 | MREDNEHERNVPSGVENVKEEGGDEDLSWGDEGCQVLRHRLRVCRKVGLLDRLCALTSLCSP | 2958 | −62 through −1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1240 | MGKPAGAVVSSWAXCSLG | 2959 | -18 through -1 |
| ID1241 | MQSTSNHLWLLSDILGQQATA | 2960 | -21 through -1 |
| ID1242 | MKKLRPSQEQLNCPEPQLADGRAGIRLLVTWLQPAPLLCLSGLELEPSA | 2961 | -49 through -1 |
| ID1243 | MWSHLNRLLFWSIFSSVTC | 2962 | -19 through -1 |
| ID1244 | MLALRDLGMGKREGEELIQAEARCLVETFQGTEGRPFDPSLLLAQATSNVVC | 2963 | -52 through -1 |
| ID1245 | MLSVGASTSLCGCLRQLRC | 2964 | -19 through -1 |
| ID1246 | MFQQMYVLLSQFLYPLAYP | 2965 | -19 through -1 |
| ID1247 | MTSHFCXIGFLSYTTS | 2966 | -16 through -1 |
| ID1248 | MICSLTPFRSLTNVLLSGSLLRSLC | 2967 | -25 through -1 |
| ID1249 | MEPPGRSSLPFSPPALTLTFLPPSPT | 2968 | -27 through -1 |
| ID1250 | MDKLKKVLSGQDTEDRSGLSEVVEASSLSWSTRIKGFIACFAIGILCSLLGTVLL | 2969 | -55 through -1 |
| ID1251 | MYSRHTVKLKQGLGMVCIFSLRLQA | 2970 | -25 through -1 |
| ID1252 | MYPSLLVDYFPSLLLYSLPLNIIG | 2971 | -24 through -1 |
| ID1253 | MATTVPDGCRNGLKSKYRLCDKAEAWGIVLETVATAGVVTSVAFMXTLPILVCKVQDSNRRKMLPTQFLFLLGVLG | 2972 | -77 through -1 |
| ID1254 | MRLQHLDHLFFSGVVLG | 2973 | -17 through -1 |
| ID1255 | MPLPKPSFSNNHLIRLITVAFGLYNPSLCHA | 2974 | -31 through -1 |
| ID1256 | MEPITFTARKHLLPNEVSVDFGLQLVGSLPVHSLTTMPMLPWWAEVRRLSRQSTRKEPVTXQXRLCVSPSGLRC | 2975 | -75 through -1 |
| ID1257 | MGCLWGLALPLFFFCWEVGVSGSSA | 2976 | -25 through -1 |
| ID1258 | MKQNTDPYLCHISLLDVTQQ | 2977 | -20 through -1 |
| ID1259 | MVTYFNFTFKPFCILASIIVPTLISLLSSPNTPSA | 2978 | -35 through -1 |
| ID1260 | MESGGRPSLCQXILLGTTSVVTA | 2979 | -23 through -1 |
| ID1261 | MEAQQAQKSAEQPEQKAATEVSXELSESQVHMMAAAVADGTRA | 2980 | -43 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1262 | MPLNSVIWFGSVXPCIS | 2981 | -17 through -1 |
| ID1263 | MLQQLDSISLRRRETANFLDFANLADLTLA | 2982 | -30 through -1 |
| ID1264 | MCYLAELSLTTFXXGYIVTSRATTTTLAIQPGLPFTTLSNLSLPSQT | 2983 | -48 through -1 |
| ID1265 | MSISLSLILLPIWINM | 2984 | -17 through -1 |
| ID1266 | MDRDLLRQSLNCHGSSLLLLRSEQQDNPHFRSLLGSAAEPARGPPPQHPLQGRKEKRVDNIEIQKFISKKADLLFALSWKSDAPA | 2985 | -86 through -1 |
| ID1267 | MVLATLVTXXNASCSFA | 2986 | -17 through -1 |
| ID1268 | MMIWKRLIILKVLLNQTCQT | 2987 | -20 through -1 |
| ID1269 | MDAGKAGQTLKTHCSAQRPDVCRMLSPFILSCCVYFCLWIPEDQLSWFAALVKCLPVLCLA | 2988 | -61 through -1 |
| ID1270 | MQQRGAAGSRGCALFPLLGVLFFQGVYI | 2989 | -28 through -1 |
| ID1271 | MLGTHIYVSLWIILFSSPHLIYWYVLLILSFP | 2990 | -32 through -1 |
| ID1272 | MSIYNLFLNLHGFLGHLLS | 2991 | -19 through -1 |
| ID1273 | MCMQVDLAFSPPPACVCMCTXSCYS | 2992 | -25 through -1 |
| ID1274 | MAPGEKESGEGPAKSALRKIRTATLVISLARG | 2993 | -32 through -1 |
| ID1275 | MEPKRGRMWXFEIEDSCIYQDIPSFVLLYPLLHLFYQHLCFP | 2994 | -42 through -1 |
| ID1276 | MEFCSVLQRCLFSFVTS | 2995 | -17 through -1 |
| ID1277 | MAESQIYVLLFFLLMKFS | 2996 | -18 through -1 |
| ID1278 | MQTNNACSLSSGPLQINA | 2997 | -18 through -1 |
| ID1279 | MGQNNASFHCPCLKVLMGLLCNQTAA | 2998 | -26 through -1 |
| ID1280 | MLPLLSVMWSPIAP | 2999 | -14 through -1 |
| ID1281 | MWLNCGGLQRWITCPPTPHGCRA | 3000 | -23 through -1 |
| ID1282 | MWQGCNCSQLSETAVDQEQLGVLTFILQRTTC | 3001 | -32 through -1 |
| ID1283 | MCLPHPQVVSSNPHILIFLLPTKMLVTLLASKSPSCP | 3002 | -37 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1284 | MHLAVLFXFSDCCRKXLSSGQLYSIVSSLSNEHVLSAGFDINTPDNLGRTCLHAAASGGNVECLNLLLSSGADL | 3003 | −74 through −1 |
| ID1285 | MSFQWCGWQWGLHDCFLSVFQVLS | 3004 | −24 through −1 |
| ID1286 | MKVHMHTKFCLICLLTFIFH | 3005 | −20 through −1 |
| ID1287 | MSFNLQSSKKLFIFLGKSLFSLLEA | 3006 | −25 through −1 |
| ID1288 | MDLMCRKVKHLLFFLLIVAAPRMVVS | 3007 | −26 through −1 |
| ID1289 | MELKSPEEEVVAALPEGMRPDSNLYGFPWELVICAAVVGFFAVLFFLMRSFX | 3008 | −52 through −1 |
| ID1290 | MELSDVTLIEGVGNEVMVVAGVVVLIALVLAWLSTYVA | 3009 | −39 through −1 |
| ID1291 | MIARRNPEPLRFLPDEARSLPPPKLTDPRLLYIGFLGYCSG | 3010 | −41 through −1 |
| ID1292 | MPPGPWESCFWVGGLILWLSVGSS | 3011 | −24 through −1 |
| ID1293 | MCARALLACSSRG | 3012 | −14 through −1 |
| ID1294 | MGDERPHYYGKHGTPQKYDPTFKGPIYNRGCTDIICCVFLLLAIVG | 3013 | −46 through −1 |
| ID1295 | MAQRLLLRRFLASVIS | 3014 | −16 through −1 |
| ID1296 | MESGGGRPSLCQFILLGTTSVVTA | 3015 | −23 through −1 |
| ID1297 | MALSSQIWAACLLLLLLLASLTSG | 3016 | −24 through −1 |
| ID1298 | MGVPRPQPWALGLLLFLLPGSLG | 3017 | −23 through −1 |
| ID1299 | MKVVPSLLLSVLLAQVWL | 3018 | −18 through −1 |
| ID1300 | MLSITVLAALLACASS | 3019 | −16 through −1 |
| ID1301 | MLGITVLAALLACASS | 3020 | −16 through −1 |
| ID1302 | MAGNGESEPDRLHLLTGHRVKGEFQLLLPLLSLPVTTP | 3021 | −38 through −1 |
| ID1303 | MLWLVLLLLPTLK | 3022 | −14 through −1 |
| ID1304 | MAPQSLPSSRMAPLGMLLGLLMAACFTFC | 3023 | −29 through −1 |
| ID1305 | MMLHSALGLCLLLVTVSSNLAIA | 3024 | −23 through −1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1306 | MCTGKCARCVGLSLITLCLVCIVANA | 3025 | -26 through -1 |
| ID1307 | MDIIVPLIQLLVLLLTLPLHLMA | 3026 | -23 through -1 |
| ID1308 | MPFIVLFSFFNIALC | 3027 | -15 through -1 |
| ID1309 | MQQRGLAIVALAVCAALHA | 3028 | -19 through -1 |
| ID1310 | MRKTRLWGLLWMLFVSELRA | 3029 | -20 through -1 |
| ID1311 | MVGAMWKVIVSLVLLMPGPCDG | 3030 | -22 through -1 |
| ID1312 | MIHLRIIQRCYMAGLENKKNVVFEAKQICIGIILVLPFIRC | 3031 | -40 through -1 |
| ID1313 | MAGSPTCLTLIYILWQLTGSAA | 3032 | -22 through -1 |
| ID1314 | MGKKGKVGKSRRDKFYHLAKETGYRSRSAFKLIQLNRRFQFLQKARALLDLCAAPXGWL | 3033 | -59 through -1 |
| ID1315 | MPLSDFILALKDNPYFGAGFGLVXVGTALALA | 3034 | -32 through -1 |
| ID1316 | MEFGLSWVFLVAIIKGVQC | 3035 | -19 through -1 |
| ID1317 | MILRKRSCSLFSSLPIFLTWA | 3036 | -21 through -1 |
| ID1318 | MKNGLMFVKLVNPCSG | 3037 | -16 through -1 |
| ID1319 | MEAVVFVFSLLDCCA | 3038 | -15 through -1 |
| ID1320 | MTGFLLPPASRGTRRSCSRSRKRQTRRPNPSSFVASCPTLLPFACVPGASXTTLA | 3039 | -56 through -1 |
| ID1321 | MCGNTMSVPLLTDAATVSG | 3040 | -19 through -1 |
| ID1322 | MXXXXERRTSPHVMADQSSTRNEDFLKKTWSLWRLQWLKDASC | 3041 | -43 through -1 |
| ID1323 | MFLLNCIVAVSQN | 3042 | -14 through -1 |
| ID1324 | MLLVSAAPLGFGQG | 3043 | -14 through -1 |
| ID1325 | MLRIALTLIPSMLSRA | 3044 | -16 through -1 |
| ID1326 | MTLGGRLPGLRCSVPGVAA | 3045 | -19 through -1 |
| ID1327 | MAFTLXSLLQAALL | 3046 | -14 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1328 | MRPLAGGLLKVVFMVFASLXA | 3047 | -21 through -1 |
| ID1329 | MFEEPEWAEAAPVAAGLGPVIS | 3048 | -22 through -1 |
| ID1330 | MHIYTGIKYIALYNIIYVCGIQG | 3049 | -23 through -1 |
| ID1331 | MMWRPSVLLLLLLLRHGAQG | 3050 | -20 through -1 |
| ID1332 | MERPLCSHLCSCLAMLALLSPLSLA | 3051 | -25 through -1 |
| ID1333 | MIHLGHILFLLLLPVAAA | 3052 | -18 through -1 |
| ID1334 | MAVKLGTLLLALALGLAQPASA | 3053 | -22 through -1 |
| ID1335 | METLGALIVLEFLLLSPVEA | 3054 | -20 through -1 |
| ID1336 | MLLPLLLSSLLGGSQA | 3055 | -16 through -1 |
| ID1337 | MLWLLFFLVTAIHA | 3056 | -14 through -1 |
| ID1338 | MAGSPSRAAGRRLQLPLLCLFLQGATA | 3057 | -27 through -1 |
| ID1339 | MKNPWTCLAILCPGPVLSPPCSGPXLALALLLVLPLLWP | 3058 | -39 through -1 |
| ID1340 | MPSWIGAVILPLLGLLLSLPAGA | 3059 | -23 through -1 |
| ID1341 | MLLHWVRSQXXSDXKLWLSLLVPSCLCA | 3060 | -28 through -1 |
| ID1342 | MKYLRHRRPNATLILAIGAFTLLFSLLVSPPTC | 3061 | -34 through -1 |
| ID1343 | MPGPRVWGKYLWRSPHSKGCPGAMWWLLLWGVLQA | 3062 | -35 through -1 |
| ID1344 | MCGPAMFPAGPWPRVRVVQVLWALLAVLLASWRLWA | 3063 | -37 through -1 |
| ID1345 | MHRRKLPLTNKRQLQKXLSKFIFSDELFRNILFSLRTLRMILSLLLLSTALNILA | 3064 | -55 through -1 |
| ID1346 | MKLWVSALLMAWFGVLS | 3065 | -17 through -1 |
| ID1347 | MQLPLALCLVCLLVHTAFR | 3066 | -19 through -1 |
| ID1348 | MLCIHXXRIIQDSFIALKILLCSVAVXLSPS | 3067 | -31 through -1 |
| ID1349 | MGGFFPPTEVREVCANQGAAHNPDRLPFLSLFWPWAPG | 3068 | -38 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1350 | MKLFYNQLVSETKHDFAHLMILLLFSPCWM | 3069 | -30 through -1 |
| ID1351 | MPSESPPLLFFHILFHSCFS | 3070 | -20 through -1 |
| ID1352 | MSSMWSEYTIGGVKIYFPYKAYPSQLAMMNSILRGLNSKQHCLLESPTGSGKSLALLCSALAWQQSLS | 3071 | -68 through -1 |
| ID1353 | MALFLELFLNSYSLLFVRFLGFVSCLQS | 3072 | -28 through -1 |
| ID1354 | MNEDEKEMKEILMAGSSLSAGVSG | 3073 | -24 through -1 |
| ID1355 | MGSFLLGGIIPLIXXLSLCLC | 3074 | -21 through -1 |
| ID1356 | MLQVATTNYLELAREVKPVCLLCSGCSCAWS | 3075 | -31 through -1 |
| ID1357 | MFCLAPFFLALCFPKSTS | 3076 | -18 through -1 |
| ID1358 | MSESRFQPQNQGGSLQLPLQCLLCCISPPVFC | 3077 | -32 through -1 |
| ID1359 | MPKHCHSFITSSCLLGLLHLSSQ | 3078 | -23 through -1 |
| ID1360 | MCLLFXFIXFPFLFPFSFS | 3079 | -19 through -1 |
| ID1361 | MASERXPNRPXCLLVASGXAEGVSA | 3080 | -25 through -1 |
| ID1362 | MPPDYKLGGSYLLAFQLVFLRATSG | 3081 | -25 through -1 |
| ID1363 | MRRISLTSSPVRLLLXLXLLIALE | 3082 | -25 through -1 |
| ID1364 | MTFLLLLFXNAGRS | 3083 | -14 through -1 |
| ID1365 | MRTVVLTMKASVIEMFLVLLVTGVHS | 3084 | -26 through -1 |
| ID1366 | MSSPLLVEQSSTKSPKSWSWSFLAFSCISLLFIFFSIANS | 3085 | -40 through -1 |
| ID1367 | MYLFCLFSVSKTIPLLLLFFHLSFL | 3086 | -25 through -1 |
| ID1368 | MIVCLLILKFLSPAET | 3087 | -16 through -1 |
| ID1369 | MDKSIKSSIIWSLILCFLFILHTHT | 3088 | -25 through -1 |
| ID1370 | MFFIFINGFTLLLMTLAMKPRHPIFDLLLLLXXSNQ | 3089 | -36 through -1 |
| ID1371 | MCPSLEEAPSVKGTLPCSGQQQPFPFGASNIPLLLGRSRKVARGAPVLWPFLTWINPALS | 3090 | -60 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1372 | MLQDLLSALWFCHPCCL | 3091 | -17 through -1 |
| ID1373 | MMDLRPLLSLAAYLSGPHQ | 3092 | -19 through -1 |
| ID1374 | MEMPPCLLPGLPLVRTSFS | 3093 | -19 through -1 |
| ID1375 | MTVELWLRLRGKGLANLHVTRGVXG | 3094 | -25 through -1 |
| ID1376 | MSIEDFVNRSILILLLCSSPPDRV | 3095 | -24 through -1 |
| ID1377 | MRIHYLLFALLFLFLVPVPG | 3096 | -20 through -1 |
| ID1378 | MCLLTALVTQVIS | 3097 | -13 through -1 |
| ID1379 | MMGNPGLALVAGTPPSRS | 3098 | -18 through -1 |
| ID1380 | MNHLMPLTVLHSVLEMLRTPRTPPWPCVSLLWAPRXFA | 3099 | -38 through -1 |
| ID1381 | MGHVVFGDIKNSLLXLRASQLSEG | 3100 | -24 through -1 |
| ID1382 | MAGGRRDYSQLFGRGPGRLSRARASVVRWSPRATACPAPPSLLPDLKRQELVSRIECCGRGPVGATADFFLSLLXSVSETPG | 3101 | -81 through -1 |
| ID1383 | MFWXGSLWCFHSFISFSLS | 3102 | -19 through -1 |
| ID1384 | MAWPNVFQXGSLLSQFXXHHVVVFLLTFFSYSLLHA | 3103 | -36 through -1 |
| ID1385 | MILRNLWILAVGLSLPSSS | 3104 | -19 through -1 |
| ID1386 | MLTVNDVRFYRNVRSNHFPFVRLCGLLHLWLKVFS | 3105 | -35 through -1 |
| ID1387 | MNLKPGLPCNLFLNLCILAXPFS | 3106 | -23 through -1 |
| ID1388 | MMQGEAHPSASLLDRTIKMRKETEARKVVLAWGLLNVSMA | 3107 | -40 through -1 |
| ID1389 | MMNQTHPXXLLILAHITQS | 3108 | -19 through -1 |
| ID1390 | MGLPERRGLVLLLSLAEILF | 3109 | -20 through -1 |
| ID1391 | MWGLEEDRSYQGLRPLCWALLYNCFSSS | 3110 | -28 through -1 |
| ID1392 | MLCRDGSACVPRSRRLPLPAAVPAHGPMADXXDSARGCVVFEDVFVYPSREEWELLDDAQRLLYHDVMLENFALLASLGIAFSRS | 3111 | -85 through -1 |
| ID1393 | MLITRLQSGIDFAIQLDESTDIGSCTTLLVYVRYAWQDDFLEDFLCFLNLTSHLSG | 3112 | -56 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1394 | MESPQLHCILNSNSVACSFAVGAGFLAPLSCLAFLVLD | 3113 | -38 through -1 |
| ID1395 | MSNKYIKPSMSPGNTDHLFLLFPRSCSS | 3114 | -28 through -1 |
| ID1396 | MVELKQLGPRSFFFLFLLPPXPP | 3115 | -24 through -1 |
| ID1397 | MPYVTIPYIIVYSLILPALFFFPLHC | 3116 | -26 through -1 |
| ID1398 | MPPLAAVMGSLPLLLCMDLPHSVLS | 3117 | -25 through -1 |
| ID1399 | MLQIPERREFLFLGFPSNSWP | 3118 | -21 through -1 |
| ID1400 | MFVHFLITLFCCCVVVG | 3119 | -18 through -1 |
| ID1401 | MACFGEKRHAKSCLLHLRCLQLYWA | 3120 | -25 through -1 |
| ID1402 | MVDRDENILLKQIYSPLSLALQSSCCLC | 3121 | -28 through -1 |
| ID1403 | MKVKPPFVSVSLCVCDCVRG | 3122 | -20 through -1 |
| ID1404 | MISSCGVKYLFSHASLFFMVGSTGSLILLTSCFYTLVSS | 3123 | -39 through -1 |
| ID1405 | MGGGIAESFLCNFLVSLSLS | 3124 | -20 through -1 |
| ID1406 | MDALERGSLRNEQALVIYAGLAYFLCCQGVIFG | 3125 | -33 through -1 |
| ID1407 | MEYLFQQPGHSRGEARAAASLETLSSLWFLPLPTHVYT | 3126 | -39 through -1 |
| ID1408 | MVSSMLITILSFIFA | 3127 | -15 through -1 |
| ID1409 | MPLFTMNLVSALASSAXG | 3128 | -18 through -1 |
| ID1410 | MICKHYCIKKNNLDYLNRMVYSAQLKLILLLHCSIRVFF | 3129 | -39 through -1 |
| ID1411 | MKIPVWHKTCFLKSESFSPDNLSVSLPCRPSQVPSQGQGKSFLLLQLIHEDKA | 3130 | -53 through -1 |
| ID1412 | MGAAVFFGCTFVAFXPAFA | 3131 | -19 through -1 |
| ID1413 | MVGGLDPPGRRRFQKGFDWRNLMSSCWLAPLADG | 3132 | -34 through -1 |
| ID1414 | MSKMPVFASLLVVSCFYQISG | 3133 | -21 through -1 |
| ID1415 | MXVTQLLPFSSPDSA | 3134 | -15 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1416 | MGKAWQEMRVEWGADKGNVRSSFHFLPWALGAMA | 3135 | -34 through -1 |
| ID1417 | MKVMMRKRKKKDQCLPGICRSLKRRKSPRSPGMKVIRLSQFLLKCWP | 3136 | -47 through -1 |
| ID1418 | MTFSFFCFFPGFKPLLFHYFLFXSFSIXTLLWGLNC | 3137 | -36 through -1 |
| ID1419 | MAGGMKVAVSPAVGPGPWGSGVGGGGTVRLLLILSGCLVYG | 3138 | -41 through -1 |
| ID1420 | MVEMTGVWQCQAEAVKGLPPLLSCSCPPPLLG | 3139 | -32 through -1 |
| ID1421 | MQITPGSAAGLLPLLGNAPG | 3140 | -21 through -1 |
| ID1422 | MLLSTWLLLTLQNSVFT | 3141 | -17 through -1 |
| ID1423 | MAFHSYWGKSLQSFKTFMRVCIVLALCHTSRP | 3142 | -32 through -1 |
| ID1424 | MKLRFTLLPLVLHSQS | 3143 | -16 through -1 |
| ID1425 | MMIILGFAFCPGHFRFNFIPFLVIYSFVLS | 3144 | -30 through -1 |
| ID1426 | MNRVPADSPNMCLICLLSYIALGAIHA | 3145 | -27 through -1 |
| ID1427 | MDLFLNLPLVIGTIP | 3146 | -15 through -1 |
| ID1428 | MXXNHRNKKSIHFPLCTTIPSXMXKSCTLPLQRTWDXXPSFVHWXQARLQSPPXSHLVXLSVIRSTLVLSQCLC | 3147 | -73 through -1 |
| ID1429 | MSFIALVYSSLSFQ | 3148 | -14 through -1 |
| ID1430 | MVFDTLKSRIVLFLNSXPPIIC | 3149 | -22 through -1 |
| ID1431 | MLEMEMTWLRLCDECSRWGMASAWGRGGKLLGAQVALHPRNCSKAKIFLFSILLMSLRT | 3150 | -59 through -1 |
| ID1432 | MDDLMLFFLGALCRESG | 3151 | -17 through -1 |
| ID1433 | MVLGALNLPSQELPTLLLPVGAPG | 3152 | -25 through -1 |
| ID1434 | MLVSKIQTFVSFLSIPVLG | 3153 | -19 through -1 |
| ID1435 | MCNPVAHTFRGVHEHHANLLSTGLNILGTQA | 3154 | -31 through -1 |
| ID1436 | MQCWILLWEACTGRCQA | 3155 | -17 through -1 |
| ID1437 | MTGYPWANSITTVLCILGCHGNLCC | 3156 | -25 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1438 | MVSCDVXSYVIFTALFLXLHSVA | 3157 | -24 through -1 |
| ID1439 | MKSFDKKLFAIFLMCLKSIG | 3158 | -20 through -1 |
| ID1440 | MFGAGDEDTDFLSPSGGARLASLFGLDQXAXG | 3159 | -33 through -1 |
| ID1441 | MVLTLGESMPVLVGRRFLSLSAADGXDX | 3160 | -28 through -1 |
| ID1442 | MVIELTSVFQAMIWSQG | 3161 | -17 through -1 |
| ID1443 | MESTLGAGIVIAEALQNQLAWLENVWLMXXLXXXIPXILFLFYFPAAYYA | 3162 | -50 through -1 |
| ID1444 | MIIVSELGTPTGVLVGVFLSTFLYC | 3163 | -25 through -1 |
| ID1445 | MNWNVRGTRGFLLCPLVCGLRR | 3164 | -22 through -1 |
| ID1446 | MLRCGGRGLLLGLAVAAAA | 3165 | -19 through -1 |
| ID1447 | MILLMIVFSIFLLL | 3166 | -14 through -1 |
| ID1448 | MSLLFIFRSILISC | 3167 | -14 through -1 |
| ID1449 | MPLISKVLIQLSQAFWA | 3168 | -17 through -1 |
| ID1450 | MDTSSVGGLELTDQTPVLLGSTAMATSLT | 3169 | -29 through -1 |
| ID1451 | MDTGESFSPHTSCRGHWRILLLTHVPPWILE | 3170 | -31 through -1 |
| ID1452 | MPYLDPYITQPIIQIERKLVLLSVLKEPVSR | 3171 | -31 through -1 |
| ID1453 | MDTSSVGGLELTDQTPVLLGSTAMATSLT | 3172 | -29 through -1 |
| ID1454 | MHVLFNIVTTNXXNHFGLLDFVVQCCDS | 3173 | -28 through -1 |
| ID1455 | MPPQSCCCSKTAYWLSFMSWAQS | 3174 | -22 through -1 |
| ID1456 | MSCVFFHFLQGGLG | 3175 | -14 through -1 |
| ID1457 | MSISLSSLILLPIWINMAQI | 3176 | -20 through -1 |
| ID1458 | MTALNLVAPFSDGDSGSVSLASFCNAVVLSPVFQ | 3177 | -34 through -1 |
| ID1459 | MWSRPVQVLGLLATCQH | 3178 | -17 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1460 | MRYRLRIQITTSLNQILLFLLISC | 3179 | -24 through -1 |
| ID1461 | MPFFSNQPTQVSVLLFFCCSPLYSP | 3180 | -25 through -1 |
| ID1462 | MRVKDPTKALPEKARSKRPTVPHDEDSDDIAVGLTCQHVSHA | 3181 | -44 through -1 |
| ID1463 | MVSLGYYLIFVLYLWLCFMQISEEKLIEEHTGTYLTSSSPLCQL | 3182 | -44 through -1 |
| ID1464 | MSLTSRXXIMXTIKIQNISITKVLCCLLIATPTFF | 3183 | -35 through -1 |
| ID1465 | MXAEAAGVVSTSVAAAVA | 3184 | -18 through -1 |
| ID1466 | MWIMSSCLALTYTNS | 3185 | -15 through -1 |
| ID1467 | MPRGVYNSNALVLVTRGSSS | 3186 | -20 through -1 |
| ID1468 | MIEPCEKMKHYDMNWFLCMYECFFFHLLETEFLLPCVHPFSVIA | 3187 | -44 through -1 |
| ID1469 | MAMWNRPCQXLPQQPLVAEPTAEGEPHLPTGRELTEANRFAYAALCGISLSQXFP | 3188 | -55 through -1 |
| ID1470 | MEQVCLLVSYAVDSAAG | 3189 | -17 through -1 |
| ID1471 | MRKISHCLHCWPESGATLRCWASTPVSG | 3190 | -28 through -1 |
| ID1472 | MCINDHIIKLLHPCGSITLTSS | 3191 | -22 through -1 |
| ID1473 | MRCRVALQCGLTIPALX | 3192 | -17 through -1 |
| ID1474 | MTVRYGKFLSLLKDGAENDLTWVLKHCERFLKQQQTSIKSSLLCLQGNYAGHDMFVSSLFMIMLGDKEKTFQFLHQFSRLLTSAFLWLPRLHI | 3193 | -93 through -1 |
| ID1475 | MAFDVSCFFWVVLFSAGCKV | 3194 | -20 through -1 |
| ID1476 | MLTRLVLSAHLSSTTSPPWTHA | 3195 | -22 through -1 |
| ID1477 | MRYFQGPSPYSEIEIELCDHVYSFQGLCVNLLLGFEPVIS | 3196 | -40 through -1 |
| ID1478 | MXXKRTHXXXSVFNGLVYAAGGRNAEGSLASLECYVPSTNQ | 3197 | -41 through -1 |
| ID1479 | MFLKVQSQSFYXPYRDCLNFHKSTYLLFFHLLLNDFFT | 3198 | -38 through -1 |
| ID1480 | MQPLKIIFYLSVSIWILIIYTPQCNS | 3199 | -27 through -1 |
| ID1481 | MWRTTARVAACTAAAPLQA | 3200 | -19 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1482 | MEAATTLHPGPRPALPLGARARWASSCLHPSARS | 3201 | -34 through -1 |
| ID1483 | MQGVRGPVSFSWSTTMLCPVIFPPSNCWK | 3202 | -29 through -1 |
| ID1484 | MXXFSFXLLFXXFXFFRQ | 3203 | -18 through -1 |
| ID1485 | MLLLSEALSESVRLLFRFSVIMA | 3204 | -23 through -1 |
| ID1486 | MALISLPCTTAFPLLSS | 3205 | -17 through -1 |
| ID1487 | MSEEEAAQIPRSSVWEQDQQNVVQRVVALPLVRATCT | 3206 | -37 through -1 |
| ID1488 | MAAAAAGAAASGLPGPVAQGLKEALVDTLTGLLSPVQEVRAAAEEQIKVLEVTEEFGVHLAELTVDPQGALA | 3207 | -72 through -1 |
| ID1489 | MNSGGGFGLGLGFGLTPTSVIQVTNLSSAVTSEQMRTLFSFLGEIEELRLYPPDNAPLAFSSXVCYVKFRDPSSVGVAQHLTNTVFIDRXLXSCSLCRRLVSRFXXXYLNFCPVCYC | 3208 | -117 through -1 |
| ID1490 | MIEMLIFLDCVLS | 3209 | -13 through -1 |
| ID1491 | MHPFLAAHGPAFHKGYKHSTINIVDIYPMMCHILGLKPHPNNGTFGHTKCLLVDQWCINLPEAIAIVIGSLLVLTMLTC | 3210 | -79 through -1 |
| ID1492 | MIWPMSASVATLWS | 3211 | -14 through -1 |
| ID1493 | MGIDIFYPSHIPDFHPIHLFIYLVFVECLLC | 3212 | -31 through -1 |
| ID1494 | MKELNQKLTNKNNKIEDLEQEIKIQKQKETLQEEITSLQSSVQEYEERNXKIKQLLVKTKKELADSKQAETDHLIIQASLKGELEA | 3213 | -87 through -1 |
| ID1495 | MGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLLLCILIIVCYI | 3214 | -113 through -1 |
| ID1496 | MLILADTRRVQGGTLGLIPAVLNRVHVAYAIPSIPSLFC | 3215 | -39 through -1 |
| ID1497 | MLVGIYPCVFLFPLISNTSS | 3216 | -20 through -1 |
| ID1498 | MFLAPSLLITKLLTGSESPDGNPPALGRPLLLQGACPCLIFL | 3217 | -42 through -1 |
| ID1499 | MDPSASKSCLFYLQKVSG | 3218 | -18 through -1 |
| ID1500 | MSLTASGPRAAWERVGGLHTWGANIPTAPDSQRWLCLQAYLASFS | 3219 | -46 through -1 |
| ID1501 | MKYQMVSGSAQLASPLLPGATP | 3220 | -22 through -1 |
| ID1502 | MNGTFPGTYVYLVAYGDLRIFGCFWGLMYXWLLLG | 3221 | -35 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1503 | MGPSTPLLILFLLSWSGPLQG | 3222 | -21 through -1 |
| ID1504 | MKFISTSLLLMLLVSSLSPVQG | 3223 | -22 through -1 |
| ID1505 | MNYQYGFNMVMSHPHAVNEIALSLNNKNPRTKALVLELLAAVCLVRG | 3224 | -47 through -1 |
| ID1506 | MAQSIHMYAARVQWGLVMCFLSYFGTFA | 3225 | -28 through -1 |
| ID1507 | MGSGYSHSLHLFHLLIRPXQG | 3226 | -21 through -1 |
| ID1508 | MARCFSLVLLLTSIWT | 3227 | -16 through -1 |
| ID1509 | MAMRYNRLTVLAGAMLALGLMTCLSVLFGYATS | 3228 | -33 through -1 |
| ID1510 | MPQQPVEQGSPLLRQLLLPLPPFSFP | 3229 | -26 through -1 |
| ID1511 | MPSRSPFTWSHLCWRAGRCPRWRACLSSSSVRMCSPAAPSRFGALGXSARRWPRRDADTWCAPQGVMRASLLPMLLGSWA | 3230 | -80 through -1 |
| ID1512 | MSHTEVKLKIPFGNKLLDAVCLVPNKSLTYGIILTHGASG | 3231 | -40 through -1 |
| ID1513 | MELGSCLEGGREAAEBEGEPEVKKRRLLCXEFXSVASCDA | 3232 | -40 through -1 |
| ID1514 | MGRTYIVEETVGQYLSNINLQGKAFVSGLLIGQCSS | 3233 | -36 through -1 |
| ID1515 | MGSRKCGGCLSCLLIPLALWS | 3234 | -21 through -1 |
| ID1516 | MGSRKCGGCLSCLLIPLALWS | 3235 | -21 through -1 |
| ID1517 | MWWFQQGLSFLPSALVIWTSA | 3236 | -21 through -1 |
| ID1518 | MFNASTFTDWSSSIFFVTFKSKKSAGLPLIFSLWCSGVLL | 3237 | -41 through -1 |
| ID1519 | MKMASSLAFLLLNFHVSLLLVQLLTPCSA | 3238 | -29 through -1 |
| ID1520 | MHILQLLTTVDDGIQAIVHCPDTGKDIWNLLFDIVCHEFCQS | 3239 | -42 through -1 |
| ID1521 | MSDQIKFIMDSLNKEPFRKNYNLITFXSLEPMQLLQVLSDVLA | 3240 | -43 through -1 |
| ID1522 | MATSSQXRQLLSDYGPPSLGYTQGTGNSQXPQSKYAELLAIIXELGKEIRPMYAGSKSAMERLKRGIIHAXGLVRECLA | 3241 | -79 through -1 |
| ID1523 | MRLLGAAAVAALGRG | 3242 | -15 through -1 |
| ID1524 | MAQRLLLRRFLASVIS | 3243 | -16 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1525 | MFRLNSLSALAELAVG | 3244 | -16 through -1 |
| ID1526 | MSGSNGSKENSHNKARTSPYPGSKVERSQVPNEKVGMLVEWQDYKPVEYTAVSVLAGPRWA | 3245 | -61 through -1 |
| ID1527 | MRTTLMFSLTAQWXTS | 3246 | -16 through -1 |
| ID1528 | MSDLLLLGLIGGLTLLLLLTLLAFA | 3247 | -25 through -1 |
| ID1529 | MEGTEMGARPGGHPXKKWSFLWSLALWLPLALS | 3248 | -32 through -1 |
| ID1530 | MXFLRKVXSILSLQVLLTTVTSTVFLYPESVRTFVXESPALILLFALGSLGLIFA | 3249 | -55 through -1 |
| ID1531 | MAATLGPLGSWQQWRRCLSARDGSRMLLLLLLGSGQG | 3250 | -38 through -1 |
| ID1532 | MSSWMYLGYPIVTSNTTCLKLISSSFPQILPFLLFPPVNA | 3251 | -41 through -1 |
| ID1533 | MAPGVIIIQLCLLLLPSCSLS | 3252 | -21 through -1 |
| ID1534 | MRHGFIQQQFSLTAFSXXXXIFTLXXLSQLLSSAAPKHTAAPTALPCLQGQQLNSLSLGTSELSCVLASSCLSTKTDPSGLSLSLGASAPVQC | 3253 | -93 through -1 |
| ID1535 | MFQNIQKCLNVPFVRGYHVFYINLNAVILIIFLSFLPFINS | 3254 | -41 through -1 |
| ID1536 | MSLSQRGFPVLALFLSGSLA | 3255 | -20 through -1 |
| ID1537 | MAARWRFWCVSVTMVVALLIVCDVPSASA | 3256 | -29 through -1 |
| ID1538 | MFAPAVMRAFRKNKTLGYGVPMLLLIVGGSFG | 3257 | -32 through -1 |
| ID1539 | MELPSGPGPERLFDSHRLPGDCFLLLVLLLYAPVGFC | 3258 | -37 through -1 |
| ID1540 | MAQSQGWVXRYXKAFCKGFFVAVPVAVTFLDRVACVARVEGASMQPSLNPGGSXSSDVVXXNHWKVRNFEVHRGDIVSLVLLTVTPSXRQ | 3259 | -90 through -1 |
| ID1541 | MSSAAADHWAWLLVLSFVFGCNV | 3260 | -23 through -1 |
| ID1542 | MNLFKTNHVFFLLLLAHIIA | 3261 | -20 through -1 |
| ID1543 | MPALLPVASRLLLLPRVLLTMASG | 3262 | -24 through -1 |
| ID1544 | MIGSGLAGSGGAGGPSSTVTWCALFSNHVAATQASLLLSFVMPALLPVASRLLLLPRVLLTMASG | 3263 | -66 through -1 |
| ID1545 | MPALLPVASRLLLLPRVLLTMASG | 3264 | -24 through -1 |
| ID1546 | MEASWGSFNAERGWYVSVQQPEEAEAEELSPLLSNELHRQRSPGVSFGLSVFNLMNAIMGSGILGLAYVMANTGVFGFSFLLLTVALLASYS | 3265 | -92 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1547 | MPSSFFLLLRFFLRIDG | 3266 | -17 through -1 |
| ID1548 | MKRTHLFIVGIYFLSSCRA | 3267 | -19 through -1 |
| ID1549 | MGDKIWLPFPVLLLAALPPVLLP | 3268 | -23 through -1 |
| ID1550 | MPHSSLHPSIPCPRGHGAQKAALVLLSACLVTLMGLG | 3269 | -37 through -1 |
| ID1551 | MGAWGRGWPWEERQGHHLLLLLLPAPTLK | 3270 | -29 through -1 |
| ID1552 | MGQCGITSSKTVLVFLNLIFWGAAGILCYVGAVFITYDDYDHFFEDVYTLIPAVVIIAVRALLFIIGLIGCCAT | 3271 | -75 through -1 |
| ID1553 | MPXAFSVSSFPVSIPAVLTQTDWTEPWLMGLATFHALCVLLTCLSSRSYRLQIGHFLCLVILVYC | 3272 | -65 through -1 |
| ID1554 | MLLSLFFPLRISL | 3273 | -14 through -1 |
| ID1555 | METGERARLILIVLQLLLRIRR | 3274 | -23 through -1 |
| ID1556 | MCGXXFSLPCLRLFLVVTCYXLLLLHKEILGCSSVCQLCTG | 3275 | -41 through -1 |
| ID1557 | MNPVTESPSCLFSPPSESALASQLALSASCDQRAPFSLAGVXSXXPRLASRQVAPPFGSRACCFLSAFSPTLT | 3276 | -73 through -1 |
| ID1558 | MSRSSKVVLGLSVLLTAATVA | 3277 | -21 through -1 |
| ID1559 | MGIQTSPVLLASLGVGVLVTLLGLAVG | 3278 | -26 through -1 |
| ID1560 | MYPSYLLIXPPIPSQFLKQCXPPTLSDPFLPLALRSLDVLLLSSAXLVXXS | 3279 | -51 through -1 |
| ID1561 | MEQKHRXELEQLKLXTKENKILLLXTFQTWCLR | 3280 | -33 through -1 |
| ID1562 | MMTAPVLAAQTLKFLTLLQKSNA | 3281 | -23 through -1 |
| ID1563 | MDSAACAAAATPVPALALAXAPDLAQA | 3282 | -27 through -1 |
| ID1564 | MASLGLQLVGYILGLLGLLGTLVA | 3283 | -24 through -1 |
| ID1565 | MASLGLQLVGYILGLLGLLGTLVA | 3284 | -24 through -1 |
| ID1566 | MLCSLLLCECLLLVAGYA | 3285 | -18 through -1 |
| ID1567 | MASRLCGGALWYVCPCPSGAWM | 3286 | -22 through -1 |
| ID1568 | MTSALTQGLERIPDQLGYIVLSEGAVLA | 3287 | -28 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1569 | MASPSRRLQTKPVITCFKSVLLIXTXIXWITGVILLAVGIWG | 3288 | -42 through -1 |
| ID1570 | MADAASQVLLGSGLTILSQP | 3289 | -20 through -1 |
| ID1571 | MSRNLRTALIFGGFISLIGA | 3290 | -20 through -1 |
| ID1572 | MPHGLWCFHLVVLSLYS | 3291 | -17 through -1 |
| ID1573 | MSLVAVFLSCGLIS | 3292 | -14 through -1 |
| ID1574 | MMKRAAAAVGGALAVGAVPVVLS | 3293 | -24 through -1 |
| ID1575 | MAVIVDKPMFYDMKKVWEGYPIQSTIPSQYWYMIELSFYWSLLFSIASDVKRKDFKEQIIHHVATILISFSWFANYIRA | 3294 | -81 through -1 |
| ID1576 | MIISLFIYIFLTCSNT | 3295 | -16 through -1 |
| ID1577 | MAAELVEAKNMVMSFRVSDLQMLLGFVGRSKS | 3296 | -32 through -1 |
| ID1578 | MTGLSMXGGGSXXGDVXPXYYGKXGPLRXLPEPSGPLPPSSGLSQPQVHALCPLSPLVTT | 3297 | -60 through -1 |
| ID1579 | MQMYSRQLASXEWLTIQGGLLGXGLXXXSLT | 3298 | -31 through -1 |
| ID1580 | MASLEVSRSPRRSRRELEVRSPRQNKYSVLLPTYNERENLPLIVWLLVKSFSES | 3299 | -54 through -1 |
| ID1581 | MDKDSQGLLDSSLMASGTAS | 3300 | -20 through -1 |
| ID1582 | MGLLTFGYIEXXXKTEHNPDHHSCLAVSWEAAGCHG | 3301 | -36 through -1 |
| ID1583 | MGLYAAVAGVLAGVES | 3302 | -16 through -1 |
| ID1584 | MGLYAAAAGVLAGVESRQGSIKGLVYSSNFQNVKQLYALVCETQRYSAVLDAVIASAGLLDA | 3303 | -62 through -1 |
| ID1585 | MGAQHTALLLNTEVRWLSRGKVLVRLFELRRELLVFMDSAFRLSDCLTNSSWLLRLAYLADIFT | 3304 | -64 through -1 |
| ID1586 | MSLRNLWRDYKVLVVMVPLVGLIHL | 3305 | -25 through -1 |
| ID1587 | MVLRSLVEYSQDVLAHPVSEEHLPDVSLIGEFSDPAELGKLLQLVLIGCAIS | 3306 | -51 through -1 |
| ID1588 | MIHGFCLAPTTSA | 3307 | -13 through -1 |
| ID1589 | MXCPRTWCLACVEASPG | 3308 | -17 through -1 |
| ID1590 | MADVEDGEETCALASHSGSSG | 3309 | -21 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1591 | MFKVAAPPMLIXXIIMFLLIIVCGSP | 3310 | -26 through -1 |
| ID1592 | MDFWDPAVFXMCLWSLRNLFS | 3311 | -21 through -1 |
| ID1593 | MSPAGKHNSESKFTFFVALDGSVPLLSLSHSIGI | 3312 | -34 through -1 |
| ID1594 | MHWALVCVGLHTEGPWG | 3313 | -17 through -1 |
| ID1595 | MFGAAARSADLVLLEKNLQAAHGYAQEDRERNHRXIVSLXQNLLNFMIGSILDLMQCFLWFYIGSSLNGTRG | 3314 | -72 through -1 |
| ID1596 | MAARWRFWCVSVTMVALLIVCDVPSA | 3315 | -27 through -1 |
| ID1597 | MVVLLLQPSMIQEVWT | 3316 | -16 through -1 |
| ID1598 | MLHLHXSCLCFRSWLPAMLAVLLSLAPSASS | 3317 | -31 through -1 |
| ID1599 | MRVRIGLTLLLCAVLLSLASA | 3318 | -21 through -1 |
| ID1600 | MGLHLRPYRVGLLPDGLLFLLLLMLLA | 3319 | -28 through -1 |
| ID1601 | MATLSFVFLLLGAVSWPPASA | 3320 | -21 through -1 |
| ID1602 | MFLFLSPATPVLPPSLDSRDLLPHLFWGRAGSSSSPALSPVLCLRGLVSLAFQ | 3321 | -54 through -1 |
| ID1603 | MWAMESGHLLWALLFMQSLWP | 3322 | -21 through -1 |
| ID1604 | MTHYRNILGLLCCVLATMA | 3323 | -19 through -1 |
| ID1605 | MKLLLLASLIERSS | 3324 | -15 through -1 |
| ID1606 | MARNQALVCLPSFQNAFIPVEDLPTSFXLFLALCASFS | 3325 | -38 through -1 |
| ID1607 | MPNESWQIPCGKQEAETLFNFQSLLLLFYSFYVLA | 3326 | -35 through -1 |
| ID1608 | MQTTFIDVTVDQHVAKSNDHLSVLVLLICLVSSYLP | 3327 | -36 through -1 |
| ID1609 | MALGEEKAEAEASXDTKAQSYGRGSCRERELDIPGPMSGEQPPRLEAEGGLISPVWGAEXYLPLLAGLGLTLA | 3328 | -73 through -1 |
| ID1610 | MTSLYLKHLLCISPFVPPTSG | 3329 | -21 through -1 |
| ID1611 | MTDSPNAHGLALTTKWMPAVSLNLTYYLPSWYLCLATLTLFHTSFS | 3330 | -47 through -1 |
| ID1612 | MASSHWNETTSVYQYLGFQVQKIYPFHDNWNTACFVILLLFIFTVVS | 3331 | -48 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1613 | MSLLFVFCLECSIFLLNMWVACLLS | 3332 | -25 through -1 |
| ID1614 | MFVVTVLLLLPLVAFITL | 3333 | -18 through -1 |
| ID1615 | MNRSCRNTGIIYALQFLFIVFA | 3334 | -22 through -1 |
| ID1616 | MTQTTWGAPTRASNHPLPAMLTLSLLLAWVTLTHL | 3335 | -35 through -1 |
| ID1617 | MLKXXAVLCVCAAAWC | 3336 | -16 through -1 |
| ID1618 | MISAHCNLHLLGSSISPASA | 3337 | -20 through -1 |
| ID1619 | MXXKACRTLAWLPXPFLPFLLSLPLDQT | 3338 | -28 through -1 |
| ID1620 | MAVKRLGLLLVFLPHPQRG | 3339 | -19 through -1 |
| ID1621 | MQAVDNLTSAPGNTSLCTRDYKITQVLFPLLYTVLFFVGLITNGLAMRIFFQIRSKSNFIIFLKNTVISDLLMILTPFKILS | 3340 | -83 through -1 |
| ID1622 | MWTLPSLSASFQPFLGSLRPSHILWFFLPSLXCPEC | 3341 | -36 through -1 |
| ID1623 | MSLTDVPMSLLLFQPSSHSATG | 3342 | -22 through -1 |
| ID1624 | MDWSLAFLLVSLYWSHM | 3343 | -17 through -1 |
| ID1625 | MYLLILFMVGRIIP | 3344 | -15 through -1 |
| ID1626 | MNKPPWEESWGQNQLSGEPATWSLCISPLPGREPSLLVVSCCLLFHQA | 3345 | -48 through -1 |
| ID1627 | MLLIELTWMLSFLILLSIDSLVSG | 3346 | -24 through -1 |
| ID1628 | MKLQRSPAPRIECSAILRRAERLVWNDVCSESQSQSRDSCLLGAAWASRLRT | 3347 | -52 through -1 |
| ID1629 | MVIFTLCVFTLPFLCA | 3348 | -16 through -1 |
| ID1630 | MWGALPVLVVGTWSSQGQA | 3349 | -19 through -1 |
| ID1631 | MTRLVCGFLQISLSLA | 3350 | -16 through -1 |
| ID1632 | MNFLLPLLLHHLTFH | 3351 | -15 through -1 |
| ID1633 | MLSARDRRDRHPEGVVAELQGPAVDKAFLTSHKGILLETELALTLIIFICXTASISA | 3352 | -58 through -1 |
| ID1634 | MLTMSVTLSPLRS | 3353 | -13 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1635 | MFXPVALIFPISVSDPTIHPITQAQNLESXLQSFFLLISSVRPISQ | 3354 | -46 through -1 |
| ID1636 | MLLFPFPGETVSLHHPCMCAVLRSWLAASS | 3355 | -31 through -1 |
| ID1637 | MPLKNLFSVGLMDPYNLLKKHVLVVVCYLSWRVSS | 3356 | -35 through -1 |
| ID1638 | MAMAQKLSHLLPSLRQVIQ | 3357 | -19 through -1 |
| ID1639 | MIAPTLKGTPSSSAPLAIVALAPHSVQK | 3358 | -28 through -1 |
| ID1640 | MCLFPVSPCPAYSFSSEXXGAVLLLVESLCLVFNLLS | 3359 | -37 through -1 |
| ID1641 | MKIAVLFCFLLLIF | 3360 | -15 through -1 |
| ID1642 | MCSPRSPLNLSLVPVGAVLLSSLPISP | 3361 | -27 through -1 |
| ID1643 | MGLHISLIKFLLANGPHIPSHQRPFEPKGEKSCRIEVVTLPLTSHCLA | 3362 | -48 through -1 |
| ID1644 | MKTTYVIFMQSKALLTLYVFVASSMQ | 3363 | -26 through -1 |
| ID1645 | MNALVFLIFLRFINI | 3364 | -15 through -1 |
| ID1646 | MQLGPLHTVSTPFFCWGFLLTGHSLSHS | 3365 | -29 through -1 |
| ID1647 | MGRGWERTVCSLGWRGGPDPLSWATCWSGARSRHTRVSSIVNGYVGSVCCCCVGPLRG | 3366 | -57 through -1 |
| ID1648 | MPEAVEQSAHLFVTWSSQRALS | 3367 | -22 through -1 |
| ID1649 | MPGTHTFTFKSCWLIALSVPLVFW | 3368 | -24 through -1 |
| ID1650 | MLLLTFKWFLFCLIGLDLLCQV | 3369 | -22 through -1 |
| ID1651 | MATTGRRQAEPPPVRPAHSRPPPVPGSSSLGLAGLMSPVPNLHLLLPLTTP | 3370 | -52 through -1 |
| ID1652 | MVPFIYLQAHFTLCSG | 3371 | -16 through -1 |
| ID1653 | MFFSFLLTINLVSL | 3372 | -14 through -1 |
| ID1654 | MWPGRECKNWGLLCFASECTT | 3373 | -21 through -1 |
| ID1655 | MLTPFSLEEKLLECHYVLAKLAGACLLLTLRQPPTHS | 3374 | -37 through -1 |
| ID1656 | MKRIKSMMGKVEHIKIKGEKQRSRHVKIVFVGLIFLKSSA | 3375 | -40 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1657 | MQSALCLFCKICPFTHG | 3376 | -17 through -1 |
| ID1658 | MMHNIIVKELIVTFFLGITVVQMLISVTGLKGVEAQNGSESEVFVGKYETLVFYWPSLLCLAFLLGRFL | 3377 | -69 through -1 |
| ID1659 | MSNCLQNFLKITSTRLLCSRLCQQLRS | 3378 | -27 through -1 |
| ID1660 | MSGXGLFLRTTAAARA | 3379 | -16 through -1 |
| ID1661 | MNPLHKHCAAGPLTWLHLLLSHLKS | 3380 | -25 through -1 |
| ID1662 | MPKDKRGARHNSPHFSFAVLRVLHLPALT | 3381 | -29 through -1 |
| ID1663 | MTIHVLRKCCQMGRLNNEWLPGLVIPLCVSRQLLTGART | 3382 | -39 through -1 |
| ID1664 | MQAASFGRGPNGLDNWGIAALLGLLQLRFK | 3383 | -30 through -1 |
| ID1665 | MSPSLGDRCSSWLHLVSHLESISGPLLNIPENLLLCCHRCTNC | 3384 | -43 through -1 |
| ID1666 | MSGAEPTTFIRYFLLPCLINLAIG | 3385 | -24 through -1 |
| ID1667 | MVYDYFISQQLLFSFLLSTIPT | 3386 | -22 through -1 |
| ID1668 | MLFLCSCSLSLNQL | 3387 | -14 through -1 |
| ID1669 | MFFLMVLLFRSNKWT | 3388 | -15 through -1 |
| ID1670 | MLPLQGLCTCYFLHLEPLSHVTTSLASSS | 3389 | -29 through -1 |
| ID1671 | MYFYGLTFHFFLLLNTILLFG | 3390 | -21 through -1 |
| ID1672 | MRWNLFFFCILRNQTKLWASQGSLQDAQS | 3391 | -29 through -1 |
| ID1673 | MFIAALFTMAKTWN | 3392 | -14 through -1 |
| ID1674 | MPGXKHFLRVFRXSAXRSVGYXXKPGTSRASLWVXLPXXXVIAS | 3393 | -44 through -1 |
| ID1675 | MRLESPDENFAVVQEHAIHHIDGPLRRFLLLEVHEPVALGPLFVTGHFA | 3394 | -49 through -1 |
| ID1676 | MAGSPDREVLLPTVLRGSYC | 3395 | -20 through -1 |
| ID1677 | MHVSMLEGFDENLDVQGELILQDAFQVWDPKSLIRKGRERHLFLFEISLVFS | 3396 | -52 through -1 |
| ID1678 | MNVGTAHSEVNXNTRVMXXRGIWLSYVLAIGLLHIVLLS | 3397 | -39 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1679 | MLSFVXAIXXYIPTNS | 3398 | -16 through -1 |
| ID1680 | MDEYSWWCHVLEVVKGQMPTFINITLWLGSLC | 3399 | -32 through -1 |
| ID1681 | MRRKGQGHLAFIFLIQIWKTCLS | 3400 | -23 through -1 |
| ID1682 | MFLISGHVHLIYNILFLAVSSFSMP | 3401 | -25 through -1 |
| ID1683 | MTPRILSEVQFSAFCPYWTIARILERVGSACFRLELCAAIVGYFVLDVRTFLFIVVCVICVTLN | 3402 | -64 through -1 |
| ID1684 | MCSLLSGWGQLLRC | 3403 | -14 through -1 |
| ID1685 | MLFSFCFPVHFWNPSSLFPPSSVVSLIPNFSASGLCA | 3404 | -37 through -1 |
| ID1686 | MTWLRILFVIGSXL | 3405 | -15 through -1 |
| ID1687 | MSSTYCGNSSAKMSVNEVSAFSLSLEQKTGFAFVGILCIFLGLLIIRC | 3406 | -48 through -1 |
| ID1688 | MTDIWLTMLSMIVGATCY | 3407 | -18 through -1 |
| ID1689 | MXXCWIYAFISLGYILG | 3408 | -17 through -1 |
| ID1690 | MFIRTLKTTVLPFMRTAPQLALSWVPPXCRV | 3409 | -31 through -1 |
| ID1691 | MRTGAEMRTNSSVLIFCLLPYIYH | 3410 | -24 through -1 |
| ID1692 | MIVIPSWLENEGLELGFSHRTFA | 3411 | -23 through -1 |
| ID1693 | MLKKEIAHHSPSLVSCPVCTTKYRTLRLLRVISVFLSFLPSYP | 3412 | -43 through -1 |
| ID1694 | MTXPSRAQTVDXGIAKHCAYSLPGVALTLG | 3413 | -30 through -1 |
| ID1695 | MPFRLLIPLGLLCSLLAPMVLA | 3414 | -21 through -1 |
| ID1696 | MXLVLVFLCSLLAPMVLA | 3415 | -18 through -1 |
| ID1697 | MALRRPPRLRLCARLPDFFLLLLFRGCLIG | 3416 | -30 through -1 |
| ID1698 | MGGNGSTCKPDTERQGTLSTAAPTTSPAPCLSNHHNKKHLILAFCAGVLLTLLLIAFIFL | 3417 | -60 through -1 |
| ID1699 | MGTADSDEMAPEAPQHTHIDVHIHQESALAKLLLTCCSA | 3418 | -39 through -1 |
| ID1700 | MSLLSFLFARVNLG | 3419 | -14 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1701 | MARSPLRRRGRPTWSLSTPRPGSPTSSSRSRWCCPARLTLTSG | 3420 | -43 through -1 |
| ID1702 | MKIITTLLLACHLQLEVG | 3421 | -19 through -1 |
| ID1703 | MLMPVVGRGNGIPQTVSEWLRLLPFLGVLALLGYLAV | 3422 | -37 through -1 |
| ID1704 | MDRLGSFSNDPSDKPPCRGCSSYLMEPYIKCAECGPPPFFLCLQCFTRG | 3423 | -49 through -1 |
| ID1705 | MSDVNVSALPIKNSGHIYNKNISQKDCDCLHVVEPMPVRGPDVEAYCLRCECKYEERSSVTIKVTIIYLSILGLLLLYMVYLTL | 3424 | -87 through -1 |
| ID1706 | MAXCRRCRSQRRSHCCQDRRLRRPRLTLWRHHTALSLSLSMAPPNP | 3425 | -46 through -1 |
| ID1707 | MTRLGGKGGQQFPPGQKIISKDILALTALSVXRKXS | 3426 | -36 through -1 |
| ID1708 | MKGWGWLALLLGALLGTAWA | 3427 | -20 through -1 |
| ID1709 | MHRLLCLLLLFGGGDP | 3428 | -16 through -1 |
| ID1710 | MLWRQLIYWQLLALFFLPFCLC | 3429 | -22 through -1 |
| ID1711 | MRLLLLIVAASAMVRS | 3430 | -17 through -1 |
| ID1712 | MSSGXELMPGAALLVLLGVAASLC | 3431 | -25 through -1 |
| ID1713 | MTKEIFFFTXTELVCENKELCSSPRWRNAIQKSNFSKVTSFFMSCHHFKGLAPLPHVYTQGNCRPISCLGLTLMPFASS | 3432 | -78 through -1 |
| ID1714 | MTTDIGCLYFRALCLPRGAWG | 3433 | -21 through -1 |
| ID1715 | MVPSLVIPDLTCLFLFLNLRWS | 3434 | -22 through -1 |
| ID1716 | MALRLLKLAATSASA | 3435 | -15 through -1 |
| ID1717 | MWGNKFGVLLFLYSVLLTKG | 3436 | -20 through -1 |
| ID1718 | MYTFRKLSPYLNKIVFVCSSVLGQSWG | 3437 | -27 through -1 |
| ID1719 | MESRVLLRTFCLIFGLGAVWG | 3438 | -21 through -1 |
| ID1720 | MLVLKKHSVNIAAQTCFKFNFIFRILIFLGFFLGLFH | 3439 | -37 through -1 |
| ID1721 | MDVKCPGCYKITTVFSHAQTVVLCVGCSTVLC | 3440 | -32 through -1 |
| ID1722 | MCIILSVLHALPAGIA | 3441 | -16 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1723 | MLVVEASSVRLASSEVTSWSIIVTPSASTPIISLSAGPLRTPSHSKTWLLGALEPASE | 3442 | -60 through -1 |
| ID1724 | MYSFPTTVVEEILSLSLQLIAPPTVSC | 3443 | -27 through -1 |
| ID1725 | MLMLLPLRSLLALVRE | 3444 | -16 through -1 |
| ID1726 | MVPLVAVVSGPPAQLFACLLRLGTQ | 3445 | -25 through -1 |
| ID1727 | MDNRFATAFVIACVLSLIST | 3446 | -20 through -1 |
| ID1728 | MPEYCGNEVTPTEAAQAPEVTYEAEEGSLWTLLLTSLDGHLL | 3447 | -42 through -1 |
| ID1729 | MNRVLCAPAAGAVRA | 3448 | -15 through -1 |
| ID1730 | MAFTFAAFCYMLALLLTAALIFF | 3449 | -23 through -1 |
| ID1731 | MXXXXEXLLAFHHDCEA | 3450 | -17 through -1 |
| ID1732 | MGPYNVAVPSDVSHARFYFLFHRPLRLLNLLILIEG | 3451 | -36 through -1 |
| ID1733 | MMNFRQRMGWIGVGLYLLASAAA | 3452 | -23 through -1 |
| ID1734 | MLFASGGFXVKLYDIEQQQIRNALENIRKEMKLLEQAGSLKGSLSVEEQLSLISGCPNIQEAVEGAMHIQECVPEDLELKKKIFAQLDSIIDESSDLKRFXFLSHAFXVVCWLGPCEA | 3453 | -118 through -1 |
| ID1735 | MQCFLGGLGLCSLPLSPSAVCP | 3454 | -22 through -1 |
| ID1736 | MSSFLLSFSQSLS | 3455 | -13 through -1 |
| ID1737 | MLTASLAFQLVDG | 3456 | -13 through -1 |
| ID1738 | MYXRRELSILCILSAFNFLVCLSLG | 3457 | -25 through -1 |
| ID1739 | MGLSAMDTSIVFGVSWVMLVYS | 3458 | -22 through -1 |
| ID1740 | MYFWRDVAVSLDTLWALPRQQPGLGNNRVLGLLSGTNKDYKGQKLAEQMFQGIILFSAIVGFIYG | 3459 | -65 through -1 |
| ID1741 | MHWGKRWXLXXGGLLICXLXIGTATP | 3460 | -26 through -1 |
| ID1742 | MAXRYNRLTVLAGAXLALGLXTCLSVLFG | 3461 | -29 through -1 |
| ID1743 | MGFTGFFTATCFISKVFMTCILCRPPISS | 3462 | -29 through -1 |
| ID1744 | MIMYLFVICVIFEIIRNYAFSILIVLLPVLFFSLK | 3463 | -35 through -1 |

TABLE III-continued

| SEQ. ID NO. OF NUCLEIC ACID ENCODING A POLYPEPTIDE CONTAINING A SIGNAL SEQUENCE | SIGNAL PEPTIDE SEQUENCE | SEQ. ID NO. OF POLYPEPTIDE CONTAINING A SIGNAL PEPTIDE | LOCATION OF SIGNAL PEPTIDE IN POLYPEPTIDE SEQUENCE |
|---|---|---|---|
| ID1745 | MSTVGLXHFPXPLTRICPAPWGLRLWEKLTLLSPGIA | 3464 | -37 through -1 |
| ID1746 | MLALAXHLSTVES | 3465 | -13 through -1 |
| ID1747 | MLLSIGMLMLXATQVYTILTVQLFAFLNLLPVEA | 3466 | -34 through -1 |
| ID1748 | MSTVGLFHFPTPLTRICPAPWGLRLWEKLTLLSPGIA | 3467 | -37 through -1 |
| ID1749 | MELTIFILRLAIYILTFPLYLLNFLGLWSWICK | 3468 | -33 through -1 |
| ID1750 | MSLLHGNKNCVTIRPTGQPLNGDLLLYLCCMINIHH | 3469 | -37 through -1 |
| ID1751 | MSFNISYFIAFPNLSQA | 3470 | -17 through -1 |
| ID1752 | MKLKXNVLTIILLPVHLLIT | 3471 | -20 through -1 |
| ID1753 | MAALVTVLFTGVRR | 3472 | -14 through -1 |
| ID1754 | MASVGECPAPVPVKDKKLLEVKLGELPSWILMRDFSPSGIFG | 3473 | -42 through -1 |
| ID1755 | MLALLVLVTVALASA | 3474 | -15 through -1 |
| ID1756 | MRIISRQIVLLFSGFWGLAMG | 3475 | -21 through -1 |

SEQUENCE LISTING (3475 sequences)

SEQ ID NO: 1 - RNA, 47 nt, Artificial Sequence
  modified_base 1: m7Gppp added to 1
  synthetic construct
ggcauccuacucccauccaauuccacccuaacuccucccaucuccac

SEQ ID NO: 2 - RNA, 46 nt, Artificial Sequence
  synthetic construct
gcauccuacucccauccaauuccacccuaacuccucccaucuccac

SEQ ID NO: 3 - DNA, 25 bp, Artificial Sequence
  synthetic construct
atcaagaattcgcacgagaccatta

SEQ ID NO: 4 - DNA, 25 bp, Artificial Sequence
  synthetic construct
taatggtctcgtgcgaattcttgat

SEQ ID NO: 5 - DNA, 25 bp, Artificial Sequence
  synthetic construct
ccgacaagaccaacgtcaaggccgc

SEQ ID NO: 6 - DNA, 25 bp, Artificial Sequence
  synthetic construct
tcaccagcaggcagtggcttaggag

SEQ ID NO: 7 - DNA, 25 bp, Artificial Sequence
  synthetic construct
agtgattcctgctactttggatggc

SEQ ID NO: 8 - DNA, 25 bp, Artificial Sequence
  synthetic construct
gcttggtcttgttctggagtttaga

SEQ ID NO: 9 - DNA, 25 bp, Artificial Sequence
  synthetic construct
tccagaatgggagacaagccaattt

SEQ ID NO: 10 - DNA, 25 bp, Artificial Sequence
  synthetic construct
agggaggaggaaacagcgtgagtcc

SEQ ID NO: 11 - DNA, 25 bp, Artificial Sequence
  synthetic construct
atgggaaaggaaaagactcatatca

SEQ ID NO: 12 - DNA, 25 bp, Artificial Sequence
  synthetic construct
agcagcaacaatcaggacagcacag

SEQ ID NO: 13 - DNA, 25 bp, Artificial Sequence
  synthetic construct
atcaagaattcgcacgagaccatta

SEQ ID NO: 14 - DNA, 67 bp, Artificial Sequence
  synthetic construct
  misc_feature 67: n=a, g, c or t
atcgttgagactcgtaccagcagagtcacgagagagactacacggtactggttttttttttttttvn

SEQ ID NO: 15 - DNA, 29 bp, Artificial Sequence
  synthetic construct
ccagcagagtcacgagagagactacacgg

SEQ ID NO: 16 - DNA, 25 bp, Artificial Sequence
  synthetic construct
cacgagagagactacacggtactgg

SEQ ID NO: 17 - DNA, 526 bp, Homo Sapiens
  Lymph ganglia
  misc_feature complement(261..376): blastn; identity 96; region 166..281
  id N70479
  misc_feature complement(380..486): est; blastn; identity 97; region 54..160
  id N70479
  misc_feature complement(110..145): est; blastn; identity 94; region 403..438
  id N70479
  misc_feature complement(196..229): est; blastn; identity 94; region 315..348
  id N70479
  sig_peptide 90..140: est; Von Heijne matrix
  score 8.2
  seq LLLITAILAVAVG/FP
  misc_feature 290: n=a, g, c or t
  unsure 24: position 24 of amino acid sequence
  unsure 50: Xaa = Phe,Ile; position 50 of amino acid sequence; Xaa = Lys,Asn
aatatraracagctacaatattccagggccartcacttgccatttctcataacagcgtcagagagaaagaactgactgaracgtttgagatgaagaaagttctcctcctgatcacagccatcttggcagtggctgtwggtttcccagtctctcaagaccaggaacgagaaaaaagaagtatcagtgacagcgatgaattagcttcaggrwtttttgtgttcccttacccatatccatttcgcccacttccaccaattccatttccaagatttccatggtttagacgtaantttcctattccaatacctgaatctgcccctacaactccccttcctagcgaaaagtaaacaaraaggaaaagtcacrataaacctggtcacctgaaattgaaattgagccacttccttgaaraatcaaaattcctgttaataaaaraaaaacaaatgtaattgaaatagcacacagcattctctagtcaatatctttagtgatcttctttaataaacatgaaagcaaaaaaaaaaaa

SEQ ID NO: 18 - protein, 17 aa, Homo Sapiens
  SIGNAL 1..17: Von Heijne matrix; score 8.2; seq LLLITAILAVAVG/FP
MKKVLLLITAILAVAVG

SEQ ID NO: 19 - DNA, 822 bp, Homo Sapiens
  kidney
  misc_feature 260..464: blastn; identity 96; region 153..357
  id H57434
  misc_feature 118..184: est; blastn; identity 98; region 98..164
  id H57434
  misc_feature 56..113: est; blastn; identity 98; region 35..92
  id H57434
  misc_feature 454..485: est; blastn; identity 100; region 348..379
  id H57434
  misc_feature 118..545: est; blastn; identity 98; region 1..428
  id N27248
  misc_feature 65..369: est; blastn; identity 98; region 41..345
  id H94779
  misc_feature 61..399: est; blastn; identity 99; region 6..344
  id H09880
  misc_feature 408..458: est; blastn; identity 92; region 355..405
  id H09880
  misc_feature 60..399: est; blastn; identity 97; region 56..395
  id H29351
  misc_feature 393..432: est; blastn; identity 90; region 391..430
  id H29351
  sig_peptide 346..408: est; Von Heijne matrix
  score 5.5
  seq SFLPSALVIWTSA/AF
  misc_feature 115: n=a, g, c or t
  unsure 31: position 31 of amino acid sequence; Xaa = Glu,Lys
actccttttagcataggggcttcggcgccagcggccagcgctagtcggtctggtaagtgcctgatgccgagttccgtctctcgcgtcttttcctggtcccaggcaaagcggasgnagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatatagacccggctttaccttatatcagtgacactggtacagtagctccaraaaaatgcttatttggggcaatgctaaatattgcggcagttttatgtcaaaaatagaaatcaggaarataattcaacttaaagaakttcatttcatgaccaaactcttcaraaacatgtctttacaagcatatctcttgtattgctttctacactgttgaattgtctggcaatatttctgcagtggaaaatttgatttarmtagttcttgactgataaatatggtaaggtgggcttttccccctgtgtaattggctactatgtcttactgagccaagttgtawtttgaaataaaatgatatgagagtgacacaaaaaaaaaaa

SEQ ID NO: 20 - protein, 21 aa, Homo Sapiens
  SIGNAL 1..21: Von Heijne matrix; score 5.5; seq SFLPSALVIWTSA/AF
MWWFQQGLSFLPSALVIWTSA

SEQ ID NO: 21 - DNA, 405 bp, Homo Sapiens
  Testis
  misc_feature complement(103..398): blastn; identity 96; region 1..296
  id AA442893
  sig_peptide 185..295: est; Von Heijne matrix
  score 5.9
  unsure 3: seq LSYASSALSPCLT/AP; position 3 of amino acid sequence; Xaa = Lys,Asn
atcaccttcttctccatccttstctgggccagtccccarcccagtccctctcctgacctgcccagcccaagtcagccttcagcacgcgcttttctgcacacagatattccaggcctacctggcattccaggacctccgmaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgaccgctccaaaktccccccggcttgctatgatgcctgacaactaaatatccttatccaaatcaataaarwraraatcctccctccaraagggtttctaaaaacaaaaaaaaaa

SEQ ID NO: 22 - protein, 37 aa, Homo Sapiens
  SIGNAL 1..37: Von Heijne matrix; score 5.9; seq LSYASSALSPCLT/AP
MVLTTLPLPSANSPVNMPTTGPNSLSYASSALSPCLT

SEQ ID NO: 23 - DNA, 496 bp, Homo Sapiens
  Cancerous prostate
  misc_feature 149..331: blastn; identity 98; region 1..183
  id AA397994
  misc_feature 328..485: est; blastn; identity 96; region 179..336
  id AA397994
  misc_feature complement(182..496): est; blastn; identity 97; region 14..328
  id AA399680
  sig_peptide 196..240: est; Von Heijne matrix
  score 5.5
  seq ILSTVTALTFAXA/LD
  misc_feature 101: n=a, g, c or t
  unsure 35: position 35 of amino acid sequence
  unsure -2: Xaa = His,Gln
  position -2 of amino acid sequence
  unsure 26..27: Xaa = Lys,Arg; position 26 to 27 of amino acid sequence; Xaa = Ser,Thr
aaaaaattggtcccagttttcaccctgccgcagggctggctggggagggcagcggtttagattagccgtggcctaggccgtttaacggggtgacacgagcntgcagggccgagtccaaggcccggagataggaccaaccgtcaggaatgcgaggaatgtttttcttcggactctatcgaggcacacagacagaccatggggattctgtctacagtgacagccttaacatttgccaragccctggacggctgcagaaatggcattgcccaccctgcaagtgagaagcacagactcgagaaatgtagggaactcgagascasccactcggccccaggatcaacccascaccgaagaaaaacaaccagaagaaattattcttcagcctgaaatgaakccgggatcaaatggttgctgatcaragcccatatttaaattggaaaagtcaaattgascattattaaataaagcttgtttaatatgtctcaaacaaaaaaaa

SEQ ID NO: 24 - protein, 15 aa, Homo Sapiens
  SIGNAL 1..15: Von Heijne matrix
  score 5.5
  seq ILSTVTALTFAXA/LD
  unsure 14: Xaa = any one of the twenty amino acids
MGILSTVTALTFAXA

SEQ ID NO: 25 - DNA, 623 bp, Homo Sapiens
  Testis
  sig_peptide 49..96: Von Heijne matrix
  score 10.1
  unsure 69: seq LVLTLCTLPLAVA/SA
  position 69 of amino acid sequence
  unsure 106: Xaa = Lys,Asn
  position 106 of amino acid sequence
  unsure 118: Xaa = Gln,Arg
  position 118 of amino acid sequence
  unsure 134: Xaa = Lys,Arg
  position 134 of amino acid sequence
  unsure 141: Xaa = Ile,Asn; position 141 of amino acid sequence; Xaa = Gly,Arg
aaagatccctgcagcccggcaggagagaaggctgagccttctggcgtcatggagaggctcgtcctaaccctgtgcaccctcccgctggctgtggcgtctgctggctgcgccacgacgccagctcgcaacctgagctgctaccagtgcttcaaggtcagcagctggacggagtgcccgcccacctggtgcagcccgctggaccaagtctgcatctccaacgaggtggtcgtctcttttaaatggagtgtacgcgtcctgctcagcaaacgctgtgctcccagatgtcccaacgacaacatgaakttcgaatggtcgccggcccccatggtgcaaggcgtgatcaccaggcgctgctgttcctgggctctctgcaacagggcactgaccccacaggaggggcgctgggccctgcraggggggctcctgctccaggacccttcgaggggcaraaaaacctgggtgcggccacagctggggctcccactctgccttcccawttccaaccccctctgcccargggaaacccaggaaggataacactgtgggtgcccccacctgtgcattgggaccacracttcaccctcttggaracaataaactctcatgcccccaaaaaaaaaaaa

SEQ ID NO: 26 - protein, 16 aa, Homo Sapiens
  SIGNAL 1..16: Von Heijne matrix; score 10.1; seq LVLTLCTLPLAVA/SA
MERLVLTLCTLPLAVA

SEQ ID NO: 27 - DNA, 848 bp, Homo Sapiens
  kidney
  sig_peptide 32..73: Von Heijne matrix
  score 10.7
  unsure 156: seq LWLLFFLVTAIHA/EL
  position 156 of amino acid sequence
  unsure 157: Xaa = Ile,Lys,Arg
  position 157 of amino acid sequence
  unsure 170: Xaa = Lys,Arg
  position 170 of amino acid sequence
  unsure 171: Xaa = Asp,Asn; position 171 of amino acid sequence; Xaa = Lys,Asn
aactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtadaaraaagaacaaagaaccatctgaagtggatgacgctgaarataaktgtgaaaacatgatcacaattgaaaatggcatcccctctgatcccctggacatgaagggagggcatattaatgatgccttcatgacagaggatgagaggctcacccctctctgaagggctgttgttctgcttcctcaaraaattaaacatttgtttctgtgtgactgctgagcatcctgaaataccaagagcagatcatatwttttgtttcaccattcttcttttgtaataaattttgaatgtgcttgaaaaaaaaaaaaac

SEQ ID NO: 28 - protein, 14 aa, Homo Sapiens
  SIGNAL 1..14: Von Heijne matrix; score 10.7; seq LWLLFFLVTAIHA/EL
MLWLLFFLVTAIHA

SEQ ID NO: 29 - DNA, 25 bp, Artificial Sequence
  synthetic construct
gggaagatggagatagtattgcctg

SEQ ID NO: 30 - DNA, 26 bp, Artificial Sequence
  synthetic construct
ctgccatgtacatgatagagagattc

SEQ ID NO: 31 - DNA, 546 bp, Homo Sapiens
  promoter 1..517
  misc_feature 518: transcription start site
  protein_bind 17..25: matinspector prediction; name CMYB_01
  score 0.983
  protein_bind complement(18..27): sequence tgtcagttg; matinspector prediction; name MYOD_Q6
  score 0.961
  protein_bind complement(75..85): sequence cccaactgac; matinspector prediction; name S8_01
  score 0.960
  protein_bind 94..104: sequence aatagaattag; matinspector prediction; name S8_01
  score 0.966
  protein_bind complement(129..139): sequence aactaaattag; matinspector prediction; name DELTAEF1_01
  score 0.960
  protein_bind complement(155..165): sequence gcacacctcag; matinspector prediction; name GATA_C
  score 0.964
  protein_bind 170..178: sequence agataaatcca; matinspector prediction; name CMYB_01
  score 0.958
  protein_bind 176..189: sequence cttcagttg; matinspector prediction; name GATA1_02
  score 0.959
  protein_bind 180..190: sequence ttgtagataggaca; matinspector prediction; name GATA_C
  score 0.953
  protein_bind 284..299: sequence agataggacat; matinspector prediction; name TAL1ALPHAE47_01
  score 0.973
  protein_bind 284..299: sequence cataacagatggtaag; matinspector prediction; name TAL1BETAE47_01
  score 0.983
  protein_bind 284..299: sequence cataacagatggtaag; matinspector prediction; name TAL1BETAITF2_01
  score 0.978
  protein_bind complement(287..296): sequence cataacagatggtaag; matinspector prediction; name MYOD_Q6
  score 0.954
  protein_bind complement(302..314): sequence accatctgtt; matinspector prediction; name GATA1_04
  score 0.953
  protein_bind 393..405: sequence tcaagataaagta; matinspector prediction; name IK1_01
  score 0.963
  protein_bind 393..404: sequence agttgggaattcc; matinspector prediction; name IK2_01
  score 0.985
  protein_bind 396..405: sequence agttgggaattc; matinspector prediction; name CREL_01
  score 0.962
  protein_bind 423..436: sequence tgggaattcc; matinspector prediction; name GATA1_02
  score 0.950
  protein_bind complement(478..489): sequence tcagtgatatggca; matinspector prediction; name SRY_02
  score 0.951
  protein_bind 486..493: sequence taaaacaaaaca; matinspector prediction; name E2F_02
  score 0.957
  protein_bind complement(514..521): sequence tttagcgc; matinspector prediction; name MZF1_01; score 0.975; sequence tgagggga
tgagtgcagtgttacatgtcagttgggttaagtttgttaatgtcattcaaatcttctatgtcttgatttgcctgctaattctattatttctggaactaaattagtttgatggttctattagttattgactgaggtgtgctaatctcccattatgtggatttatctatttcttcagttgtagataggacattgatagatacataagtaccaggacaaaagcagggagatcttttttccaaaatcaggagaaaaaaatgacatctggaaaacctatagggaaaggcataacagatggtaaggatactttatcttgagtaggagagccttcctgtggcaacgtggagaagggaagaggtcgtagaattgaggagtcagctcagttagaagcagggagttgggaattccgttcatgtgatttagcatcagtgatatggcaaatgtgggactaagggtagtgatcagagggttaaaattgtgtgttttgttttagcgctgctggggcatcgccttgggtcccctcaaacagattcccatgaatctcttcat

SEQ ID NO: 32 - DNA, 23 bp, Artificial Sequence
  synthetic construct
gtaccagggactgtgaccattgc

SEQ ID NO: 33 - DNA, 24 bp, Artificial Sequence
  synthetic construct
ctgtgaccattgctcccaagagag

SEQ ID NO: 34 - DNA, 861 bp, Homo Sapiens
  promoter 1..806
  misc_feature 807: transcription start site
  protein_bind complement(60..70): matinspector prediction; name NFY_Q6
  score 0.956
  protein_bind 70..77: sequence ggaccaatcat; matinspector prediction; name MZF1_01
  score 0.962
  protein_bind 124..132: sequence cctgggga; matinspector prediction; name CMYB_01
  score 0.994
  protein_bind complement(126..134): sequence tgaccgttg; matinspector prediction; name VMYB_02
  score 0.985
  protein_bind 135..143: sequence tccaacggt; matinspector prediction; name STAT_01
  score 0.968
  protein_bind complement(135..143): sequence ttcctggaa; matinspector prediction; name STAT_01
  score 0.951
  protein_bind complement(252..259): sequence ttccaggaa; matinspector prediction; name MZF1_01
  score 0.956
  protein_bind 357..368: sequence ttggggga; matinspector prediction; name IK2_01
  score 0.965
  protein_bind 384..391: sequence gaatgggatttc; matinspector prediction; name MZF1_01
  score 0.986
  protein_bind complement(410..421): sequence agagggga; matinspector prediction; name SRY_02
  score 0.955
  protein_bind 592..599: sequence gaaaacaaaaca; matinspector prediction; name MZF1_01
  score 0.960
  protein_bind 618..627: sequence gaagggga; matinspector prediction; name MYOD_Q6
  score 0.981
  protein_bind 632..642: sequence agcatctgcc; matinspector prediction; name DELTAEF1_01
  score 0.958
  protein_bind complement(813..823): sequence tcccaccttcc; matinspector prediction; name S8_01
  score 0.992
  protein_bind complement(824..831): sequence gaggcaattat; matinspector prediction; name MZF1_01
  score 0.986
  sequence agagggga
  misc_feature 335,376: n=a, g, c or t
tactatagggcacgcgtggtcgacggccgggctgttctggagcagagggcatgtcagtaatgattggtccctggggaaggtctggctggctccagcacagtgaggcatttaggtatctctcggtgaccgttggattcctggaagcagtagctgttctgtttggatctggtagggacagggctcagagggctaggcacgagggaaggtcagaggagaaggsaggsarggcccagtgagargggagcatgccttcccccaaccctggcttscycttggymamagggcgkttytgggmacttraaytcagggcccaascagaascacaggcccaktcntggctsmaagcacaatagcctgaatgggatttcaggttagncagggtgagaggggaggctctctggcttagttttgttttgttttccaaatcaaggtaacttgctcccttctgctacgggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcac

SEQ ID NO: 35 - DNA, 20 bp, Artificial Sequence
  synthetic construct
ctgggatggaaggcacggta

SEQ ID NO: 36 - DNA, 20 bp, Artificial Sequence
  synthetic construct
gagaccacacagctagacaa

SEQ ID NO: 37 - DNA, 555 bp, Homo Sapiens
  promoter 1..500
  misc_feature 501: transcription start site
  protein_bind 191..206: matinspector prediction; name ARNT_01
  score 0.964
  protein_bind 193..204: sequence ggactcacgtgctgct; matinspector prediction; name NMYC_01
  score 0.965
  protein_bind 193..204: sequence actcacgtgctg; matinspector prediction; name USF_01
  score 0.985
  protein_bind complement(193..204): sequence actcacgtgctg; matinspector prediction; name USF_01
  score 0.985
  protein_bind complement(193..204): sequence cagcacgtgagt; matinspector prediction; name NMYC_01
  score 0.956
  protein_bind complement(193..204): sequence cagcacgtgagt; matinspector prediction; name MYCMAX_02
  score 0.972
  protein_bind 195..202: sequence cagcacgtgagt; matinspector prediction; name USF_C
  score 0.997
  protein_bind complement(195..202): sequence tcacgtgc; matinspector prediction; name USF_C
  score 0.991
  protein_bind complement(210..217): sequence gcacgtga; matinspector prediction; name MZF1_01
  score 0.968
  protein_bind 397..410: sequence catgggga; matinspector prediction; name ELK1_02
  score 0.963
  protein_bind 400..409: sequence ctctccggaagcct; matinspector prediction; name CETS1P54_01
  score 0.974
  protein_bind complement(460..470): sequence tccggaagcc; matinspector prediction; name AP1_Q4
  score 0.963
  protein_bind complement(460..470): sequence agtgactgaac; matinspector prediction; name AP1FJ_Q2
  score 0.961
  protein_bind 547..555: sequence agtgactgaac; matinspector prediction; name PADS_C; score 1.000; sequence tgtggtctc
ctatagggcacgcktggtcgacggcccgggctggtctggtctgtkgtggagtcgggttgaaggacagcatttgtkacatctggtctactgcaccttccctctgccgtgcacttggcctttkawaagctcagcaccggtgcccatcacagggccggcagcacacacatcccattactcagaaggaactgacggactcacgtgctgctccgtccccatgagctcagtggacctgtctatgtagagcagtcagacagtgcctgggatagagtgagagttcagccagtaaatccaagtgattgtcattcctgtctgcattagtaactcccaacctagatgtgaaaacttagttctttctcataggttgctctgcccatggtcccactgcagacccaggcactctccggaagcctggaaatcacccgtgtcttctgcctgctcccgctcacatcccacacttgtgttcagtcactgagttacagattttgcctcctcaatttctcttgtcttagtcccatcctctgttcccctggccagtttgtctagctgtgtggtctc

SEQ ID NO: 38 - DNA, 155 bp, Homo Sapiens
  Brain
  sig_peptide 45..86: Von Heijne matrix; score 10.80; seq LLLLGLCLGLSLC/VG
agtgtcccgccgggtccccgagcgtcccgcgccctcgccccgccatgctcctgctgctggggctgtgcctggggctgtccctgtgtgtggggtcgcaggaagaggcgcagagctggggccactcttcggagcaggatggactcagggtcccgagg

SEQ ID NO: 39 - DNA, 427 bp, Homo Sapiens
  Brain
  sig_peptide 191..268: Von Heijne matrix; score 10.80; seq VLLFFVLLGMSQA/GS
aagtacacgcggmgaactgggaagacagaaagwwcaatcctttaagggagaacctagaagccattcaacaaggttaaaatctttaggcttccgaggatttggtagacagatcagaggcacgtttcccacaactgcgaagaggcgctgaggcaattctgcaagaagattttggggttttggaaaagaagctatggaaaacggaggggcaggcactctgcagataaggcaagtcctgcttttctttgttttgctgggaatgtctcaggcgggctctgaaactgggaactttttggtgatggaggaattgcagagcgggagctttgtaggaaatttggcaaagaccctgggactcgaggtgagtgagctgtcttcgcggggggctcgggtggtttctaatgataacaaagagtgtttgcagctggacacg

SEQ ID NO: 40 - DNA, 398 bp, Homo Sapiens
  Brain
  sig_peptide 12..389: Von Heijne matrix; score 10.00; seq LKLLLFLSTELQA/SQ
aaaaaaggaccatgagagggccggagccgggtccccaaccgacgatggagggagacgtgctggacacactggaggcgctggggtataaaggaccattgttagaagagcaagcccttacaaaggcggcagagggtggattatcttcacctgaattttcagagctctgtatttggttaggctctcaaataaaatcattatgcaacttggaagaaagtatcacgtctgctggaagagatgatctagagagcttccagcttgagataagtggctttttaaaagaaatggcatgtccatattctgtactcatatcaggagatattaaagatcgtttaaaaaagaaggaggactgtttgaaacttctattatttttaagtacagaacttcaagcttcacagata

SEQ ID NO: 41 - DNA, 201 bp, Homo Sapiens
  Brain
  sig_peptide 70..147: Von Heijne matrix; score 9.60; seq WLIALASWSWALC/RI
agcccggtttcgtgcccgcggccgactgcgcasctgtccgcgagtctgagatacttacagagagctacaatggaaaagtcctggatgctgtggaactttgttgaaagatggctaatagccttggcttcatggtcttgggctctctgccgtatttctcttttacctttaatagtgacttttcatctgtatggaggttcgggg

SEQ ID NO: 42 - DNA, 272 bp, Homo Sapiens
  Brain
  sig_peptide 6..113: Von Heijne matrix; score 9.50; seq LGLLLLARHWCIA/GV
agattatgcagcagactcgcacagaggctgtcgcgggcgcgttctctcactgcctgggcttctgtggaatgagactcgggctccttctacttgcaagacactggtgcattgcaggtgtgtttccgcagaagtttgatggtgacagtgcctacgtggggatgagtgacggaaacccagagctcctgtcaaccagccagacctacaacggccagagcgagaacaacgaagactatgagatccccccgataacacctcccaacctcccggaagcg

SEQ ID NO: 43 - DNA, 186 bp, Homo Sapiens
  Brain
  sig_peptide 28..99: Von Heijne matrix; score 9.10; seq LVVFLLLPLASGP/QV
atttacgtcttttcagtttttttagagatggaaaagggaaacgcgtttttaaagaataggttagttgtttttcttctcctgcccctagcatcaggaccacaggtaaaaaggaaaagcgaaattacgaaacttataaaggccacgcgaatcatttgtttattcaataaatttagtagaggaaacggg

SEQ ID NO: 44 - DNA, 400 bp, Homo Sapiens
  Brain
  sig_peptide 164..235: Von Heijne matrix; score 9.00; seq LLMLIVFHAASMA/LQ
agttaatttgaacaaaatatagtaagtatactattattttccatgtctttctaggctttttaaactctgcagtgtatttactgtactctcgtagaaggagtgccatcaactgcaattggtacaaattgtgcttatttttctgctcttttcacgttcccaaaatatgttcccattcaaccaggcaggtcttcctactcttctcatgctcattgtttttcatgctgcttccatggctttacagagactcttcctcttcgctttggtctggcattcaaaaccctcaggactgatgacaggcaaactagaatctcaaattccccatgaaaagttgactcatatctctgtcatgcatggtcccctcagttcccatcactcatacactcacatacatttattttta

SEQ ID NO: 45 - DNA, 297 bp, Homo Sapiens
  Brain
  sig_peptide 1..228: Von Heijne matrix; score 8.80; seq SLLLWMSSLPSLG/EK
atgacttcacgtagcttgcgtcgctgctcctgtctccgtgtaactcacaataaagagattttggcatcaaccgtgagcttaggggtagaagggtatatgttaggaggtgggagcagaatcaattcttcaaatcttaatgatggtgaagaagagtgctcaccagattcccttctggtctggaaaaagaaatcccttcttttgtggatgtcatctctaccatctctcggtgaaaaatatttcaagagaatcctaagatggagagagcattggaagtcatccggcccaattcccttgtgg

SEQ ID NO: 46 - DNA, 213 bp, Homo Sapiens
  Brain
  sig_peptide 10..168: Von Heijne matrix
  score 8.80
  unsure -38: seq ILLLLTVLPCIXM/GQ
  position -38 of amino acid sequence
  unsure -2,11: Xaa =  * ,Gly; position -2 and 11 of amino acid sequence; Xaa = Gly,Arg
aactgtagcatgtggacagccagtgccatggatttcagaacctgcattgccagtkgactgcctgctttgtgctacgtgcaggcctgccgcgccctgatgattgctgcctcggtcctgggtctgccggccattttactgctgctgactgttcttccctgcatcsggatgggccaggagcccggtgtggctaagtacaggsgggcccagctggct

SEQ ID NO: 47 - DNA, 319 bp, Homo Sapiens
  Brain
  sig_peptide 62..196: Von Heijne matrix; score 8.50; seq FALLSLSHPTCQA/GA
attggtgcagaggcccttcttgtctccacaccagaaggagctgagcagaggggccacagcgatgggaccccctccaacccacattaaatacctccacctgaatatttattgcaacggcaagagcactgcacctggaatccggtctcacagccttggatttgccttgctaagcctcagtcatccaacctgccaggcaggtgcacctgccgcagccctgccttctctgtggagctggtgctctcggggtgcacgagtcagggttgggaggatgctttctcacctgtacacctgtggatggtacgatcacaacccccatggg

SEQ ID NO: 48 - DNA, 260 bp, Homo Sapiens
  Brain
  sig_peptide 204..251: Von Heijne matrix; score 8.50; seq LLTFLAFTTLLFA/PP
actgttattcttcacatattatctctattagtadvwggcttctagtcacccaagttagaaatctgtgagtcatcttttgtttcttccctttcccttactgtttagttttaattgctaagtcttgttaatactacatcaggtatgattttaaaaacatttttgatgttctactgccaccaccttagttctggtactcattttgcatgttttgtcttttgactttccttgcttttacaactcttcttttcgcacccccatgg

SEQ ID NO: 49 - DNA, 365 bp, Homo Sapiens
  Brain
  sig_peptide 126..212: Von Heijne matrix; score 8.40; seq LKCLLAVLSSLFA/AI
acaaatgtgttatgattttccaggcccttcttcatctgctctcccttccttttgagcattatcccatttcatgcccccacacagattctagccataccccatgacttacaatttccccacaaagaatgcactgtggctccactccaggactttgcccatgctgggtccccttcctgaaatgccttctagctgttctctcttccctgtttgctgccatttccgtggacagactatacttgtctttctgttctaattgctctgaaatatacctctggccccccagctttcctgctcccccatcccctgtagtccttctagttttcctgtgtccccatgggacttctttatcctttttgaagctaccg

SEQ ID NO: 50 - DNA, 69 bp, Homo Sapiens
  Brain
  sig_peptide 1..48: Von Heijne matrix; score 8.30; seq VCSALLLLGIVSS/KP
atgaatttagtttgttcagctcttttacttcttggaatagtatcttccaaaccctatatgagaaagcgg

SEQ ID NO: 51 - DNA, 184 bp, Homo Sapiens
  Brain
  sig_peptide 44..148: Von Heijne matrix; score 8.30; seq AAMLIGLLAWLQT/VP
aaattacaagaaagctggacttgccgctgtggtctcaggagaaatgagtgttcttgatgacaggcaaagggacatcttagttgtccagaagcggcactcttccctggaagccgccatgttaataggattactagcctggctccagacagtgcctgctcatggctgccagttcttaccgatccgg

SEQ ID NO: 52 - DNA, 251 bp, Homo Sapiens
  Brain
  sig_peptide 138..197: Von Heijne matrix; score 8.30; seq LLIICHYLPLSLC/IP
aattttttttcactttcctaaaagccttccctttgcccatgatgccaatgactagctctgtcctgaagcaatagctagtactttccctccttcctgccacctagcatccagccgaaccttgaatcaataccagtaaaatgggtgtgaacggaaggaggctgctcattatttgccattatttacctctgagtctgtgcattcccattccttcccatattaattctctcccgcgcaacaccccccctgtcagg

SEQ ID NO: 53 - DNA, 154 bp, Homo Sapiens
  Brain
  sig_peptide 26..118: Von Heijne matrix; score 8.20; seq LECLLLYLAESSG/LR
acagaactaacctagaaagaatgatatgaaacttcgtgagtgcccggccctccgatggtcccagctgtcccagcacaagctggagtgtctattgctttacctggcagagagctccgggctcagaacaggaaatgtgggagttctccacccaagg

SEQ ID NO: 54 - DNA, 485 bp, Homo Sapiens
  Brain
  sig_peptide 78..404: Von Heijne matrix
  score 8.20
  unsure -4: seq LLRLPQLPPXCSA/GE; position -4 of amino acid sequence; Xaa = Gly,Val
accctttcgtccgctctcattggctctgctgcagccctgaccaacgctccaataggccgggatccagccatacttcaatggatcccaggggtatcttgaaggcatttcccaagcggcagaaaattcatgctgatgcatcatcaaaagtacttgcaaagattcctaggagggaagagggagaagaagcagaagagtggctgagctcccttcgggcccatgttgtgcgcactggcattggacgagcccgggcagaactctttgagaagcagattgttcagcatggcggccagctatgccctgcccagggcccaggtgtcactcacattgtggtggatgaaggcatggactatgagcgagccctccgccttctcagactaccccagctgcccccggkttgctcagctggtgaagtcagcctggctgagcttgtgccttcaggagaggaggctggtggatgtagctggattcagcatcttcatcccagt

SEQ ID NO: 55 - DNA, 276 bp, Homo Sapiens
  Brain
  sig_peptide 199..261: Von Heijne matrix; score 8.00; seq LFLVAVLVKVAEA/RK
agcctctcctgcaccctcagccggcgcgcttctcttatgggcgtctgctgcagtctggctgcggtcgaactgaaagcggcggcgggagaccaaacttagaccccgctgtggactagagaactcagagaaggcagagggagagggagagagagasabwbaagggacccgaggaggaggcttccatcacgtcattgcaggatgttctggaagctttccctgtccttgttcctggtggcggtgctggtgaaggtggcggaagcccggaagaaccggtcg

SEQ ID NO: 56 - DNA, 197 bp, Homo Sapiens
  Brain
  sig_peptide 120..173: Von Heijne matrix
  score 7.90
  seq LFSLLVLQSMATG/AT
  misc_feature 42: n=a, g, c or t
aagtttcccgggagagacgaaagcaggaacgagagcggaggnagcacagtccgccgagcacaagctccagcatcccgtcaggggttgcaggtgtgtgggaggcttgaaactgttacaatatggctttccttggactcttctctttgctggttctgcaaagtatggctacaggggccactttccctgaggaagccccg

SEQ ID NO: 57 - DNA, 299 bp, Homo Sapiens
  Brain
  sig_peptide 90..143: Von Heijne matrix; score 7.90; seq LFSLLVLQSMATG/AT
agagagcggasstagcacagtccgccgagcacaagctccagcatcccgtcagggttgcaggtgtgtgggaggcttgaaactgttacaatatggctttccttggactcttctctttgctggttctgcaaagtatggctacaggggccactttccctgaggaagccattgctgacttgtcagtgaatatgtataatcgtcttagagcagttggaagctggagaagggaaggagccagcagacaaattgcttcgtgtctgcctgcctttctcctccatttaccccttacacacacacacggg

SEQ ID NO: 58 - DNA, 370 bp, Homo Sapiens
  Brain
  sig_peptide 62..226: Von Heijne matrix; score 7.80; seq ALLVALLFTLIHR/RR
aagtgagaaaggagcttaccaaaggcagtgtacgaagaaggttcctgggagactgtcagaaatgagtttttcactgaacttcaccctgccggcgaacacaacgtcctctcctgtcacaggtgggaaagaaacggactgtgggccctctcttggattagcggcgggcataccattgctggtggccacagccctgctggtggctttactatttactttgattcaccgaagaagaagcagcattgaggccatggaggaaagtgacagaccatgtgaaatttcagaaattgatgacaatcccaagatatctgagaatcctaggagatcacccacacatgagaagaatacgatgggagcacaagaggcccgctgg

SEQ ID NO: 59 - DNA, 336 bp, Homo Sapiens
  Brain
  sig_peptide 91..330: Von Heijne matrix; score 7.70; seq LVLFLSLALLVTP/TS
tattccttggagttccacgactgaattaagactgttgtgggrdccataattttcaaatacttgccctatattcgtgttgagggttcacacatgagcacatggtatttggcacttaataagtcctataagaataaagacagcgttaggatttatctcagcttgtgcacagtgagcattaaatttacatactttcatgatatacagactaattgtcttacaacatggaaacattcgagatgcagattttattgggcatttggtggttccattttacagcactcagtggatccccttgttttgttcctaagcctggccctgttagtgacacccacttcg

SEQ ID NO: 60 - DNA, 394 bp, Homo Sapiens
  Brain
  sig_peptide 266..322: Von Heijne matrix; score 7.70; seq LQLLCCIFTLVLQ/HY
atactataaggctagaattgacttggagtcaaggcgagttccataggtttaatgcgtggcacctatctcaacaactgcaaaatcactgtaacttgtaaaaaatcccagggccactcatggacagccacatctttaaacccacacaaaaatacagacactttgattacatgaaagttagaagctctaaactagagcaaggtcagttgtggtaagaaggtattagattcaagcatccacaaaagtttatagtctgtcagtcataaggatggctattgggatttctttacagttactctgttgtattttcactttggttttacagcactatctcttaggaagtcatccatatattacctgcatacacagtcagcttcttctcgatatacagcagcag

SEQ ID NO: 61 - DNA, 429 bp, Homo Sapiens
  Brain
  sig_peptide 208..264: Von Heijne matrix
  score 7.60
  seq LLNLLLLSLFAGL/DP
  misc_feature 13,340: n=a, g, c or t
  unsure 26: position 26 of amino acid sequence; Xaa =  * ,Gly,Arg
gagaatgcctgcngaatgatcgccccccagggcggctgccgccgctgccgctgctgctgttattgctactgctgctgccgccgcctctgcttccactcggctctgactggcaggcaraaartgcaacttgamsgarggrhargtctctggcagtgagtggagagcctacataaaagagagtaaagaggggcaaaaacccagatcagaatgcaggcgacgtccaaccttctcaacctcctgctgctgtctttgtttgccggattagatccttccaagaacaaaaagagaggaagttctttttcatttaagtttcctttactagatgataccccattcctangatccagaattgaaaatagtgctacacatcatctacactatggactaaacatgattctgtgggttaattggaaacctaagctcactttg

SEQ ID NO: 62 - DNA, 189 bp, Homo Sapiens
  Brain
  sig_peptide 88..180: Von Heijne matrix; score 7.60; seq VTLLCGWPGSHWC/AP
aacaggcgtaaskacatggcccagctcgatccctcccttttgttcaacaaactaaattcgagcaggaggctctaggattccacaggcatgatgaaatggaagccggaggatctgggatcggttccttgtgaggctttctctgttactctgctgtgcggctggccagggtcgcattggtgtgccccacca

SEQ ID NO: 63 - DNA, 243 bp, Homo Sapiens
  Brain
  sig_peptide 10..66: Von Heijne matrix; score 7.60; seq LLNLLLLSLFAGL/DP
aagatcagaatgcaggcgacgtccaaccttctcaacctcctgctgctgtctttgtttgccggattagatccttccaagactcagattagtcctaaagaagggtggcaggtgtacagctcagctcaggatcctgatgggcggtgcatttgcacagttgtwgctccagaacaaaacctgtgttcccgggatgccaaaagcaggcaacttcgccaactactggaaaaggttcagaacatgtcccgg

SEQ ID NO: 64 - DNA, 397 bp, Homo Sapiens
  Brain
  sig_peptide 158..301: Von Heijne matrix; score 7.50; seq FVILLLFIFTVVS/LV
acaaacagacgmtaccatcgcttcagcagcatcctctcagacaagagccactatttctgattcagatcacctgtcatcgaagtttaaagaaggggaaacaggagacagaaatacactgaaccaaaaagattcaaaagagcaagtggaatctctaagaatggcttccagccactggaatgaaaccactacctctgtttatcagtaccttggttttcaagttcaaaaaatttaccctttccatgacaactggaacactgcctgctttgtcatcctgcttttatttatatttacagtggtatctttagtggtgctggctttcctttatgaagtgcttgactgctgctgctgtgtaaaaaacaaaaccgtgaaagacttgaaaagtgaacccaaccctcgg

SEQ ID NO: 65 - DNA, 182 bp, Homo Sapiens
  Brain
  sig_peptide 78..176: Von Heijne matrix; score 7.40; seq ITCCVLLLLNCSG/VW
atcgactgtgagctgcggcagagagcagaggcggcggcgcgggacctgcagtcgccagggattccctccaggtgacgatgctctggttctccggcgtcggggctctggctgagcgttactgccgccgctcgcctgggattacgtgctgcgtcttgctgctactcaattgctcaggggtctgg

SEQ ID NO: 66 - DNA, 256 bp, Homo Sapiens
  Brain
  sig_peptide 164..238: Von Heijne matrix; score 7.30; seq LIFFLNVTQLVRG/RG
agtaaataaaaagtttgctttattaaattatgtttagatagtgsttatagtgctttaccccttcaaaatagtaacttctatcaatcatttaggatgtgtgtcagactattctgtgtcctttaagtgtgtkaactagttttaaccctctgcaaatatctgaggtatgctctttttacagatgggaaaacaatcttggactttaatattttttcttaatgttacacaattagtaagaggcagggggccaggcggacgg

SEQ ID NO: 67 - DNA, 126 bp, Homo Sapiens
  Brain
  sig_peptide 19..99: Von Heijne matrix
  score 7.20
  seq LLLGLCSPPXXSL/AS
  misc_feature 34: n=a, g, c or t
  unsure -23: position -23 of amino acid sequence
  unsure -22: Xaa = Asp,Glu
  position -22 of amino acid sequence
  unsure -4: Xaa = Leu,Met,Val
  position -4 of amino acid sequence
  unsure -3: Xaa = Arg,Ser; position -3 of amino acid sequence; Xaa = Ile,Val
aattgattaggagattatatggagctgcgggasntgccgcctgggggaagagaggtgcagcttctgctaggtttgtgctctcctcccagsrtctccttggcttccttccccaaagcagctcagatg

SEQ ID NO: 68 - DNA, 117 bp, Homo Sapiens
  Brain
  sig_peptide 46..87: Von Heijne matrix; score 7.00; seq LWSLLSSSGSHFG/IP
agcaggcctttgggagagaaacctaatgcctaagcctcatcctttatgctctggtctcttctttcctcttcaggctcacattttggtatccctcaccacacatttccccaagaaggg

SEQ ID NO: 69 - DNA, 445 bp, Homo Sapiens
  Brain
  sig_peptide 110..265: Von Heijne matrix
  score 7.00
  seq SVWLCLLCYFAFP/FQ
  misc_feature 305: n=a, g, c or t
  unsure -34: position -34 of amino acid sequence
  unsure 14: Xaa = Ile,Arg,Ser
  position 14 of amino acid sequence
  unsure 35: Xaa = Cys,Gly,Arg,Ser
  position 35 of amino acid sequence
  unsure 36: Xaa = His,Gln,Arg; position 36 of amino acid sequence; Xaa =  * ,Gly,Ile,Leu,Arg,Val
atgcaccatgatatttttatacacgttgtgttaactactgtaaacacattgtcttctttatatttctttgcaggaagttcagaaaaaagtgtcacgttttaatctgcagatggacataagtggattaattcctggtctagtgtctacattcatacttttgtctakhagtgatcactacggacgaaaattccctatgattttgtcttccgttggtgctcttgcaaccagcgtttggctctgtttgctttgctattttgcctttccattccagcttttgattgcatctaccttcattggtgcatttngtggcaattataccacattttggggagcttgctttgcctatatagttgatcagtgtaaagaacrsdkacaaaaaacaattcgaatagctatcattgactttctacttggacttgttactggactaacagtactgtcatct

SEQ ID NO: 70 - DNA, 244 bp, Homo Sapiens
  Brain
  sig_peptide 137..226: Von Heijne matrix
  score 7.00
  unsure -29: seq LFVILLITSLIFC/SL; position -29 of amino acid sequence; Xaa =  * ,Leu
actttttgaatttgttgctggtacagttgcatgtattctcttaaaattattttgaggcctcatatctggttatttctcctttctcattccttatcttgcgtgtttttacctttttttcataactaagtttttgaggatgtwagtgttcttttcaaagaaccggttcgaaatgtacttttctttgctactttttgttattttattgatcacatctttaatcttttgttctctatacgtggcgcgt

SEQ ID NO: 71 - DNA, 390 bp, Homo Sapiens
  Brain
  sig_peptide 289..357: Von Heijne matrix; score 6.90; seq SLSLLASHHSVSC/SN
aagtacaaagcctactccaaagactgcagcttgaagataaaagagagcactgcgtccttttgaaaataaaggcagacacaaagaagaaaggagctaccttaccccagcatatacctgcgggatgttctctccagttcatttttacctggtgtcttgaaatccgagcaattcctaaaaaggcatttttgcgagcccttgtggactataccagtgacagtgctgaaaagcgcaggctacaggagctgtgcagtaaacaaggggcagccgattatagccgctttgtacgagatgcctgtgcctgcttgttggatctcctcctcgctttcccttcttgccagccaccactcagtctcctgctcgaacatcttcctaaacttcaacccagaccgg

SEQ ID NO: 72 - DNA, 374 bp, Homo Sapiens
  Brain
  sig_peptide 198..260: Von Heijne matrix
  score 6.90
  unsure 12: seq LLACGSLLPGLWQ/HL; position 12 of amino acid sequence; Xaa = Ala,Pro
atatatttctgaggcagtacccatctcacttgtaaacttaaaagacaccgcagagatttgagggactcagaagtcaaatagagtaggttaaaaacctcttatttttcaaattaattgttttaagaaacaagcatacctgtgtaagtgaaatatcttaatttgtgttgaatcaagttaggagacagagattctcatgaatgtgtcctgtgttctcaaagcagctgctagcctgtgggtctctcctacctgggttatggcagcacctcacagccaatcactggcctccattctccsctttcctctgtacagtttgctctggttcctcagagcagatttccgagtatactgcttcagccacgcccccactgtgcctg

SEQ ID NO: 73 - DNA, 416 bp, Homo Sapiens
  Brain
  sig_peptide 33..260: Von Heijne matrix; score 6.90; seq LLPLSAWPPWAWH/HH
acgctcagcaggtccactcccgtgttccggtcatggctttaacaattcatggggaaagaatgcgccccgattgggagagcccctggatcacgtcttcccaagctcagtccctgtctcttggagggagtccgtcctcgaggggccctctggtgcccaggggagagtatcttgcgtcctgtcctgagggcgtccgctcacacagccacctgctcccccgctccctccttcccttgtcagcatggccaccgtgggcctggcatcaccatgggcctggcacacagtccctcgtgggctgcctttgtgccatgagcccactgctgccgactcacctgtccctcccagtactggaaccttctggaacaccagcactaaaagataggaggccctgtgaggttggcatccccatcccccccagg

SEQ ID NO: 74 - DNA, 295 bp, Homo Sapiens
  Brain
  sig_peptide 11..286: Von Heijne matrix; score 6.80; seq ILIASSLPTLSHP/AP
aagagtcacaatggcagccagattcaggtgcggccatttgtgtgtccccgaggttcctcgcgggccggcatcccacgccgagggtggtggtggcaggctttccagaaaggcagcacaccaggctcagctctgctggcgagcaggaggcgacggcagaggaaacttcaacccgatgaacttcctggttgcggggacatttgcctcctcctgccactcaccacctctgctctggtccctccctccaagaatcctcatagcgtcctctctccccactctctcccatcccgcgcctggg

SEQ ID NO: 75 - DNA, 361 bp, Homo Sapiens
  Brain
  sig_peptide 101..187: Von Heijne matrix; score 6.80; seq VLSLICSCFYTQP/HP
actctcccctcccctccccggcactgcagcaccagccgtctgcagctccggccgccacttgcgcctctccagcctccgcagcccaaccgccgccagcaccatggccagcaccatttccgcctacaaggagaagatgaaggagctgtcggtgctgtcgctcatctgctcctgcttctacacacagccgcaccccaataccgtctaccagtacggggacatggaggtgaagcagctggacaagcgggcctcaggccagagcttcgaggtcatcctcaagtccccttctgacctgtccccagagagccctatgctctcctccccacccaagaagaaggacacctccctggaggagctgcaaaag

SEQ ID NO: 76 - DNA, 361 bp, Homo Sapiens
  Brain
  sig_peptide 2..343: Von Heijne matrix; score 6.70; seq LIPMAILLGQTQS/NS
aatgttacaagtctatggaaagccagtttatcagggccatcgaagcactcttaaaaaaggaccatatctcagatttaattctccatctcctaagtccagaccacagagaccaaaagtaatagaacgagttaaaggcactaaggtaaagtcaataagaacacagactgacttctatgcaacaaaacctaagaagatggattctaaaatgaaacattctgttcctgtgttacctcatggcgatcagcaatatttgttcagcccaagtagagaaatgcctactttttcaggtacattggaaggtcatctgattcctatggcaattcttttaggacaaacccaaagtaatagtgataccatgccg

SEQ ID NO: 77 - DNA, 388 bp, Homo Sapiens
  Brain
  sig_peptide 8..361: Von Heijne matrix; score 6.70; seq LLFAKLFGHLTSA/RR
agcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcct

SEQ ID NO: 78 - DNA, 291 bp, Homo Sapiens
  Brain
  sig_peptide 79..285: Von Heijne matrix; score 6.70; seq FFKLLLLGAMCSG/AR
aagactgtgactggaagaggagaaagaactgcatgcttgtaacggcccggatgggagtgtattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagcaagg

SEQ ID NO: 79 - DNA, 402 bp, Homo Sapiens
  Brain
  sig_peptide 61..372: Von Heijne matrix; score 6.60; seq HFSHVVWFHPTWA/QQ
attttcccgggtcttctccagctgccaccgctttactgcaaaactgacgggcgcaaaaacatgagtgactccgcgggagggcgcgctggtctccggcgttaccccaagctcccagtgtgggtggtggaggatcatcaggaggttctaccctttatataccgggccataggctcaaagcatcttcctgccagtaatgtaagttttttacatttcgactcacatccagacctccttattcctgtgaatatgccagcagacaccgtgtttgataaggaaacactctttggagaattaagtattgaaaattggattatgcctgcagtttatgctggccatttttcacatgtagtatggtttcatcccacatgggctcagcagatcagagagggcagacaccacttt

SEQ ID NO: 80 - DNA, 338 bp, Homo Sapiens
  Brain
  sig_peptide 12..152: Von Heijne matrix
  score 6.30
  seq SSCVLLTALVALA/AY
  misc_feature 243,295..296,301: n=a, g, c or t
  unsure 29,36: position 29 and 36 of amino acid sequence
  unsure 30: Xaa = His,Gln
  positon 30 of amino acid sequence
  unsure 31: Xaa = His,Lys,Asn,Pro,Gln,Thr
  positon 31 of amino acid sequence
  unsure 33: Xaa = Ile,Leu,Val
  positon 33 of amino acid sequence
  unsure 42: Xaa = Asp,Asn
  positon 42 of amino acid sequence
  unsure 48: Xaa = Asp,Gly,His,Arg
  positon 48 of amino acid sequence
  unsure 49: Xaa = Ile,Lys,Met,Asn,Arg,Ser,Thr
  positon 49 of amino acid sequence
  unsure 50: Xaa = Ile,Leu; positon 50 of amino acid sequence; Xaa =  * ,Ile,Lys,Leu,Arg,Ser,Thr
aaaacgcgtgaatgagtagctgccgcgggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacasmmdntaagtracctggtccastacctgggactgagcsrtcacctgctggcactgannwtawnattgtttcttttggcaaaaaaagcgcgtggtcttctg

SEQ ID NO: 81 - DNA, 229 bp, Homo Sapiens
  Brain
  sig_peptide 14..139: Von Heijne matrix; score 6.10; seq DLAVALSLLPAWT/ES
attaaagtcaaagatgattattcctttcaaaataaagaatctaggagggcgagtcctgctgtcgggaagggagatgtttcctgcttccgtccgtgctcctgacctggcggtggccctgtccctgctacctgcgtggacagagtctccaacacgcggcagccaccagagccaggcccgagcgcacagccgtgcattgcgaaagcaaagccgaaacacgaggtcgccccgg

SEQ ID NO: 82 - DNA, 249 bp, Homo Sapiens
  Brain
  sig_peptide 70..228: Von Heijne matrix
  score 6.00
  unsure 1: seq ALILLLLAQKGPS/XF; positon 1 of amino acid sequence; Xaa =  * ,Lys,Gln
acgtaaaaacaggtagttacaaggagtgtcttgataatgaaatttgtggtatagagtactggtgaatgtatggtgtgtagtgctcctagaaaaatagtagttagggcatttattacgataatattcatatattatgctataaagaagagggcaaatgaacctgcagcatatttgatgttgaagcctgaggctctgattctccttctgttagctcaaaagggccccagthagtttctgttagtgtggaga

SEQ ID NO: 83 - DNA, 289 bp, Homo Sapiens
  Brain
  sig_peptide 110..229: Von Heijne matrix
  score 5.90
  unsure 1: seq VCSALCSLGEVRP/XE
  position 1 of amino acid sequence
  unsure 13: Xaa = Leu,Met,Val; position 13 of amino acid sequence; Xaa = His,Gln
accctgctgggcgggaaggcggcgccccggccgaggtggcggcggctcctcagatgggagaagaagttgtccatgttcacactgggtgaaggaagctgaaaccacagacatgactgagtcctccatgaagaagctggcctccaccctgctggacgccatcaccgataaggaccccctggtgcaggagcaggtctgcagtgccctgtgctccctcggggaggtgcggccvvtggagacgctccgtgcctgcgaggagtatctgcggcasatgacaagctggcacacccgg

SEQ ID NO: 84 - DNA, 252 bp, Homo Sapiens
  Brain
  sig_peptide 76..204: Von Heijne matrix
  score 5.90
  unsure 7: seq VFLFHCTSGLSSC/KC; position 7 of amino acid sequence; Xaa = Phe,Leu,Ser
agtaraacaaaaggatatgcacacacacatatttaaatacatgtagttttttgcataaattatcactgagaggaaatgcaagaaactgattgtaataaacgctggggaaggggcctgggtggcctgtggtcagaaacaggaaggagatttcattgcaaatcttttgtatttctttttcactgtacttctggattatcttcatgcaaatgttctaaaaagcattymaaatattgcttctgttttgtggcaagt

SEQ ID NO: 85 - DNA, 366 bp, Homo Sapiens
  Brain
  sig_peptide 232..282: Von Heijne matrix
  score 5.80
  seq VPWLSSTVSCAQG/LR
  misc_feature 153: n=a, g, c or t
  unsure 25: position 25 of amino acid sequence; Xaa = Lys,Asn,Thr
atgagtggtcmggagataacacttaatgctttattcttaagtgttggaaggagcaagtaagtggtctagtgagctgtttttagaggaactgtataatatgtaacacattgtcattatattcactaactcccaaagtattcttgagatattganacaaaacaaagagcttgaatagaaaccctgagcaacaatgtatttactttccacttgcagcagaacttggcctttcagatgctccttgaagtgccttggcttagcagtactgtctcttgtgcccagggtctgagattggcacaacacagagtgcctttcttttattcaaatgtctcattatgcaaattattgctgccagccammctgcacggg

SEQ ID NO: 86 - DNA, 437 bp, Homo Sapiens
  Brain
  sig_peptide 123..209: Von Heijne matrix
  score 5.70
  seq SPAFLAVAGPGWA/RP
  misc_feature 421: n=a, g, c or t
  unsure 5: position 5 of amino acid sequence
  unsure 71: Xaa = Ala,Ser,Thr; position 71 of amino acid sequence; Xaa = Lys,Met,Arg,Thr
agctctcccatgctggtctgtggggactccatgtccaaacacgcagatcctgcctcccaggctttaattgatcctgctgccctctgggagcacccacacaagccaggctctcactggacctcatgtctggagggcggatgcaggcacggtgctcccagcaaagcacctggagtcctgccttccttgcagtggccgggccgggctgggcacgtcctggctgtdccctgaggaccaagtatgactctcagctggcccggcacctcttgcagcctcagttccctggtctgacccttgggaccctggtgcaacctgcccactggggcatgggagggggcacaggaggggtcttgggcgagggaggggggcacagctatgcagagcatggcacctgcctccagtcgtgctccacagacgtgctdangcatgtcctcctggcg

SEQ ID NO: 87 - DNA, 437 bp, Homo Sapiens
  Brain
  sig_peptide 63..116: Von Heijne matrix; score 5.60; seq WHFLASFFPRAGC/HG
aactgtggtcacatccctcaaaagtgaacagtcgccatcggaggcgtttggaggagaccgtgatgttgcagatgctgtggcatttcctagctagctttttccccagggctgggtgccacggctccagagagggggacgatcgtgaagtcagaggcaccccagcccctgcctggagagaccagatggcaagctttttggggaaacaggacggaagggctgaggccacggaaaaaagacccaccattttgctggtggttggacctgcagagcagtttcctaagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcag

SEQ ID NO: 88 - DNA, 113 bp, Homo Sapiens
  Brain
  sig_peptide 3..62: Von Heijne matrix; score 5.60; seq SLVCLLAMGKGLG/SS
acatgtattcccatcccgtgtcctcactggtgtgtctcctggccatgggcaagggactcgggtcatcccaggccctggtccagccagacacctggccccacacctccccgcgg

SEQ ID NO: 89 - DNA, 362 bp, Homo Sapiens
  Brain
  sig_peptide 87..191: Von Heijne matrix
  score 5.60
  unsure -25: seq FIFMEVLGSGAFS/EV; position -25 of amino acid sequence; Xaa = Ala,Ser,Thr
aacagacctgtacgagctggagtgggagctcaagcaggattcttcccgagtccctggcatcctcagaagcttcaactctggaggcaatgggtcgaaaggaagaagatgactgcagtdcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcacacaaggg

SEQ ID NO: 90 - DNA, 384 bp, Homo Sapiens
  Brain
  sig_peptide 241..327: Von Heijne matrix; score 5.60; seq LLPNQSLFSLARA/VR
aagcggcgcaccggghgaagatggcgttggaggtcggcgatatggaagatgggcagctttccgactcggattccgacatgacggtcgcacccagcgacaggccgctgcaattgccaaaagtgctaggtggcgacagtgctatgagggccttccagaacacggcaactgcatgtgcaccagtatcacattatcgagctgttgaaagtgtggattcaagtgaagaaagtttttctgattcagatgatgatagctgtctttggaaacgcaaacgacagaaatgttttaaccctcctcccaaaccagagccttttcagtttggccagagcagtcagaaaccacctgttgctggaggaaagaagattaacaacatatggggtgctgtgc

SEQ ID NO: 91 - DNA, 314 bp, Homo Sapiens
  Brain
  sig_peptide 141..197: Von Heijne matrix; score 5.60; seq LVVTAWFFGMCRS/KA
atcccagaacaccattgggagaacgccaggacaccgtgaaggctgagccgccactcggttctgatgccgcatccattggtcagtgcacgttctttgagcttccacttgagtgcacgttctttgagcttccacttgagtgcatgttctttgagcttccacttgtagtgactgcctggttcttcgggatgtgcaggagcaaagcgctcttaggcaatgctcgttctgccctgtgtttacaaaccaaggcctgtgccagctctactcagcctgacacccataatgagcaccatcccaggaatccctgtccctacttg

SEQ ID NO: 92 - DNA, 316 bp, Homo Sapiens
  Brain
  sig_peptide 155..286: Von Heijne matrix; score 5.50; seq FLLIVANVHFSQT/WV
ataaatagcattgtttacatcgaccaaatattgcctgtttcctttaattcaaatgcattaggttcccgcctccctctccttccccgccatgttgctgttttaaggcttcatatgtattaacatttctctgatcaaaattgtggctgttttccttatgaaccataatataatcatttgtgtgatgtacattgtgccatttttgatgactaaatgtctatatttctgccattcctgtaagagagggagttttttactgatagtagcaaatgttcacttcagtcaaacttgggtgttcagtggtaaaccatataaaggg

SEQ ID NO: 93 - DNA, 405 bp, Homo Sapiens
  Brain
  sig_peptide 247..309: Von Heijne matrix
  score 5.50
  unsure -8: seq LTGLCXCCLQALG/LA; position -8 of amino acid sequence; Xaa = Ala,Gly,Ser,Trp
attgtcttagtcccatcctctgttcccctggccagtttgtctagctgtgtggtctctgttctctccctaccgtgccttccatcccagccatccctgactacgtgtttcccccacagacatcacactggttcacctcgttgaccaccgtttccttctccccaagtctcccgggcaagggctgattctccagtctcctctgggaagctggccctgaaccacttagaacctatcgctccttcgtcacctatgtcatgtggcagcgctgcctcacttacgggtctgtgtksgtgctgcctccaagccctggggcttgcgtggcgccgtcgcggtttgacgggaccgggcctcccccctgtgttgcagatatgctgtccaaggagcctccgtggtgtgacggctcctact

SEQ ID NO: 94 - DNA, 302 bp, Homo Sapiens
  Brain
  sig_peptide 99..236: Von Heijne matrix; score 5.40; seq VLFFVGLITNGLA/MR
aaaaataccagatgccactctgcaggctgcaataactactacttactggatacattcaaaccctccagaatcaacagttatcaggtaaccaacaagaaatgcaagccgtcgacaacctcacctctgcgcctgggaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtsaag

SEQ ID NO: 95 - DNA, 99 bp, Homo Sapiens
  Brain
  sig_peptide 16..75: Von Heijne matrix
  score 5.30
  unsure -15: seq LCSSCCSWGPAAG/AL; position -15 of amino acid sequence; Xaa = Pro,Arg
agaagtagccgcaggatggcggcggctatgcssttgctctgctcgtcctgttgctcctggggcccggcggctggtgccttgcagaacccccaacgcggg

SEQ ID NO: 96 - DNA, 485 bp, Homo Sapiens
  Brain
  sig_peptide 396..470: Von Heijne matrix; score 5.30; seq SVVKVLSLRKAQA/QS
atttctgcccacgggcataagttcaaaagaaagctgcgaaaagttggagactgctgatgaaaccagtcatctccagccactcaacaagcgtcagaggacaagctctgtggtggaagagcatttccaagcctcagtatctcccactgaagccgcaccccctgccacaggagaccagagtcctggcctgggcacccagccaaagctgccatccagcagtggccttcctgctgcagacgtgtcccctgccacagctgaagagcccttgtcaccttccacacccacccgccggcctcccttcacccgagggcgactccggctgctctcctttcgatccatggaggaggccagactggtgcccacagtgaaagascaaataccctgtgctgaaggacgtcatggacttcattaaggatcagtcgctctcgcacaggagtgttgtgaaggttctttccctgaggaaagcccaggcccagagcatcctggaa

SEQ ID NO: 97 - DNA, 283 bp, Homo Sapiens
  Brain
  sig_peptide 59..142: Von Heijne matrix
  score 5.30
  unsure 47: seq RISCAFSLASSTA/RQ; position 47 of amino acid sequence; Xaa =  * ,Gly
agtgtgtgaagcgtacctarggcgggaggcgacatggwgacaggggcggycgwgctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggcagykga

SEQ ID NO: 98 - DNA, 390 bp, Homo Sapiens
  Brain
  sig_peptide 286..333: Von Heijne matrix
  score 5.30
  seq CAVSLTTAAVAFG/DE
  misc_feature 4: n=a, g, c or t
actntgtgctggtgctggcaaagtttgtgattttaagaaattctgctgtgctctccagcactgcgagcttctgccttccctgtagtttcccagatgtgatccaggtagccgagattccgctgcccgtgcttcggtagcttaagtctttgcctcagcttttttccttgcagccgctgaggaggcgataaaattggcgtcacagtctcaagcagcgattgaaggcgtcttttcaactactcgattaaggttgggtatcgtcgtgggacttggaaatttgttgtttccatgaaatcctgcgcagtgtcgctcactaccgccgctgttgccttcggtgatgaggcaaagaaaatggcggaaggaaaagcgagccgcgagagtgaagaggagacg

SEQ ID NO: 99 - DNA, 254 bp, Homo Sapiens
  Brain
  sig_peptide 138..200: Von Heijne matrix; score 5.20; seq LSLSLICLRMSLS/LY
atgtgattwtkttcctatttattttaaatacacacacccacagggctctgcccctgtaaaagaaaaaaaatcaaaacaaacaaataaataaccccaaagagatggacccaggggagaacgcgtaagtrtgaaggggcatgagtatacacgagtgtgcgtgtctttccctctcccttatttgtctccgtatgagtctctccttgtaccctccccctgcctcgatgatattactcccccagacttggaagccgcgc

SEQ ID NO: 100 - DNA, 303 bp, Homo Sapiens
  Brain
  sig_peptide 178..222: Von Heijne matrix
  score 5.20
  unsure 17: seq SGLSFLSVFSLWC/EP; position 17 of amino acid sequence; Xaa = Leu,Gln
aagatctrgaarcagtraccctctctctttgcatragtttctcttttttctctgagttacagttttgarrrcagcwrctaatttttttaatccctcgaataactcagttttaggaacattcgctctccctaagccttaccttgaaaccagtgtaggattttgctgccaccccggaagatgctgagtggactcagcttcctatccgttttctccctctggtgtgagcccacactcccggcgctgggaaatggctctgttctaggagtgcggcwrtcatcctcttcctctgcccagtgctctctg

SEQ ID NO: 101 - DNA, 380 bp, Homo Sapiens
  Brain
  sig_peptide 120..374: Von Heijne matrix
  score 5.20
  unsure -50: seq LYSILHFPFWVHG/RX
  position -50 of amino acid sequence
  unsure 2: Xaa = Cys,Phe; position 2 of amino acid sequence; Xaa =  * ,Gln
aactttgatggaatcaaaggtcatgggcgccagggcagctgttcccacatgcaggtgggggcccgccctttgttcacacctacattcaaggaattctgttgggctcataattcgttgtgatggggttaaaggacaaatctcaggcccccgcctcaggactgggagttctccgagggcaaaggtcgggctcattcatttctatgcctgccccagcctcaggccagtkcccggaagaaagcaggtccccagctccaccagtggcttctaggtctcagaacagaggctacagaccgtggcatgggcccctttgggtccaccaaagtgttcggtttggactttacagcattttgcattttcctttttgggttcacggccgayag

SEQ ID NO: 102 - DNA, 265 bp, Homo Sapiens
  Brain
  sig_peptide 65..193: Von Heijne matrix; score 5.20; seq PMQLLQVLSDVLA/EI
aatgccagtattaaggatttttttttctatttttactctttagttaaaattataagacctaattatgagtgatcaaattaaattcattatggacagtctcaataaggagccctttaggaagaactataatttaatcacgtttgattccttggagccaatgcaactattacaagttctcagtgatgttctggctgagattgacccaaaggtaagagttttctctttctttttgatgggtagcagaaagccaatttctccctcttgg

SEQ ID NO: 103 - DNA, 354 bp, Homo Sapiens
  Brain
  sig_peptide 25..336: Von Heijne matrix; score 5.10; seq SSVASLTATPSLA/SP
aaaccttgtacaacaccggccgacatgtctccttcctgcctgcaccccgacctgtggtcaatgtgtctggaggtcccctcctttacagccaccgactcagtgaactgcggctgctgtttggagctcgcgacggagccggctcggaacatcagatcaaccaccagggcttctctgctgaggtgcagctcattcacttcaaccaggaactctacgggaatttcagcgctgcctcccgcggccccaatggcctggccattctcagcctctttgtcaacgttgccagtacctctaacccattcctcagtcgcctccttaaccgcgacaccatcactcgcatctcctacaagaatgatg

SEQ ID NO: 104 - DNA, 226 bp, Homo Sapiens
  Brain
  sig_peptide 155..202: Von Heijne matrix; score 5.10; seq SFHLLLDPSSTQS/SI
aactctggaatgaaggggggaattacgggttggtggtcggcttcatgttaggaggacacccctccatctgttcacagctcagcctgtttccaatttaaagcccagaagaagccttcccagcctactcagaatcccacatcctctcctctctcttatggatctcagttttcatttattactagatccttcctctactcaatcaagcatactgaagcacctcccatgt

SEQ ID NO: 105 - DNA, 447 bp, Homo Sapiens
  Brain
  sig_peptide 289..366: Von Heijne matrix
  score 5.00
  unsure -17: seq VISVLILVGFGAC/IY
  position -17 of amino acid sequence
  unsure 17: Xaa = Pro,Thr; position 17 of amino acid sequence; Xaa =  * ,Gln
atctctgatgggcagggagagataccagggtgctgagccagtccaggactgccccctcctggcccactcagagcccctgggtgtgagaagctcgtctcccgtgggttgcattggctctgccctatctctgcctccagcacccagggcggccgcagatggcagtgtctctggggacagcagctgcgaatgagtccacgggccaacgctgagctgctcaggctgaggcggtgtgctcagcacagagcccccggaactggcatctgcagggcgtgagccaargccgccgcgatgccgcacttcctggactggttcgtgmcggtctacttggtcatctcggtcctcattctggtgggcttcggcgcctgcatctactacttcgagccgggcctgcaggaggcgcacaagtggcgcatgyagcgcccctggtggaccgcgacctccactggg

SEQ ID NO: 106 - DNA, 195 bp, Homo Sapiens
  Brain
  sig_peptide 79..168: Von Heijne matrix; score 5.00; seq IVGLLAQLEKINA/EP
aacagaaagatgacttaaagaacgtggggagtcgctcgcagttcgattatctgcaattatgaaatgaagtaactcaagatgagcaagttaaaagtgataccagaaaaaagccttaccaataattctaggatcgtaggactcctggctcaactggagaagatcaatgctgagccttcagaatcwgacactagccgg

SEQ ID NO: 107 - DNA, 166 bp, Homo Sapiens
  Brain
  sig_peptide 38..106: Von Heijne matrix
  score 5.00
  unsure 3: seq LIPAMAFLSCVRP/ES; position 3 of amino acid sequence; Xaa = Arg,Trp
aactgctgctcacagaagcagtgaggatgatgccaggatgatgtctgcctcgcgcctggctgggactctgatcccagccatggccttcctctcctgcgtgagaccagaaagcwgggagccctgcgtggaggtggttcctaatattacttatcaatgcatggagctg

SEQ ID NO: 108 - DNA, 278 bp, Homo Sapiens
  Brain
  sig_peptide 84..230: Von Heijne matrix
  score 4.90
  seq VTVCCXLVAFLFC/IL
  misc_feature 34: n=a, g, c or t
  unsure -31,-8: position -31 and -8 of amino acid sequence; Xaa = Pro,Thr
aaragactccgcccccttccttggagcgccgcgnctcgggctgagggagctcgggccaatcagagggacggccccagartggcatggtagatggaacgcagctgagaggtctgacaagaatgtaccaggtcccactamcactggatcgggatgagaccctggtacggctccgcttcaccatggtggccctggtcacggtctgctgtmcacttgtcgccttcctcttctgcatcctctggtccctgctcttccacttcaaggagacaacggccacaggg

SEQ ID NO: 109 - DNA, 217 bp, Homo Sapiens
  Brain
  sig_peptide 116..193: Von Heijne matrix; score 4.90; seq LISMLQMLAVIIT/NT
acttgaagttcyyctgggggcaatgagatggcagctatacagcgagtctgaaaagaacatccacattcctaatccctaggaatatgattattggaaaatagatataattatacaaatgaaacagaacttccttgttctcaacagtgtctggtacctaataagcatgttacaaatgttagctgtgatcattaccaacaccaccatcaccaccattggg

SEQ ID NO: 110 - DNA, 426 bp, Homo Sapiens
  Brain
  sig_peptide 55..231: Von Heijne matrix; score 4.90; seq LVEMCLEVLGSSA/GD
aattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctcbattgctgaagaattaattaaaccatatttagtagaaatgtgtttagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgat

SEQ ID NO: 111 - DNA, 95 bp, Homo Sapiens
  Brain
  sig_peptide 15..83: Von Heijne matrix; score 4.80; seq VMWLVALLEMCVC/KK
attgaaaaataaaaatgcactctagtataaaaacgaagggaagcgtcatgtggcttgttgctcttttggagatgtgtgtgtgtaagaagtccagg

SEQ ID NO: 112 - DNA, 473 bp, Homo Sapiens
  Brain
  sig_peptide 342..395: Von Heijne matrix; score 4.80; seq LEAISSLSSFVLG/RM
actgtttatagatattttgtttccctgagcaacagaaaatgcagtgcttatttaacttagcagcaatgccttgtaaaaatataagcctgcagatggcaatggcctctatttttcttccacaagtttcttccaattcagagcccgtgccttccttcagccacagagcgcacaacagcatggatgagattgagtcagccctcttacattgttggcctacagctatggagctacctttgcagagttgtccactttggggtttgagcatgggaagtaaattcagagatgcaagtatctgggagagggcatgaactcgtgagaaagtcctcatattctgagctcctatgacagttttgcctttagaagctatctcgtctcttagcagctttgttttgggcagaatgaatagcagaggggcaggaaagacccagaatcttgatgccagctccytgcttttactctgctgcttgatactg

SEQ ID NO: 113 - DNA, 386 bp, Homo Sapiens
  Brain
  sig_peptide 12..101: Von Heijne matrix
  score 4.80
  unsure 58: seq ILFCVGAVGACTL/SV; position 58 of amino acid sequence; Xaa = Asp,Glu
aatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaaccaacatgcctgtggtttcgctacggtgctcaccagcctgagaacctgtgcttggacgggtgcaaaagtgaggcagasaagttcacagtgagggaggccctcaaagaaaaccaagtttccctcactgtaaacagagtgacttcaaatgacagtgcaatttacatctgtggaatagcattccccagtgta

SEQ ID NO: 114 - DNA, 147 bp, Homo Sapiens
  Brain
  sig_peptide 10..84: Von Heijne matrix; score 4.80; seq ALFYSVVVSTVSG/NE
aagagtctgatgaatagcagtaaagaagaaatgcgcgaactggcagcgttgttttattctgtagtggtatcaacagtgtcggggaatgagttgaaatcaatgatagaacagcttataaagactacaaaagacaatcacagcctacgg

SEQ ID NO: 115 - DNA, 297 bp, Homo Sapiens
  Brain
  sig_peptide 55..210: Von Heijne matrix
  score 4.70
  unsure -46: seq LLAKALHLLKSSC/AP; position -46 of amino acid sequence; Xaa = Leu,Val
aagttgtgcgccggtccctgggcctgagctccggctccggctggggcgcctgcgatgtctcaagatggcggastgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcctccggg

SEQ ID NO: 116 - DNA, 141 bp, Homo Sapiens
  Brain
  sig_peptide 1..87: Von Heijne matrix; score 4.70; seq LCYLSIFCLGVLF/II
atgccttgtatatctctcttaggtctactttataattttgttcaagtcctctgttacttatcgatcttctgtctaggtgttctgttcattattgaacgtggttcattaaaagtctccaaattaatctgtaggccaccaggg

SEQ ID NO: 117 - DNA, 307 bp, Homo Sapiens
  Brain
  sig_peptide 167..211: Von Heijne matrix
  score 4.70
  seq IAVLFCFFLLIIF/QT
  misc_feature 10: n=a, g, c or t
aactaagvwnkttcagcaaatacttttcaacattcccttctgtcctttctttgtttttaaagaaagctctgattttgtttcattttcagctggagacttaaatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcag

SEQ ID NO: 118 - DNA, 396 bp, Homo Sapiens
  Brain
  sig_peptide 253..381: Von Heijne matrix; score 4.70; seq STWSSASLRGSWQ/QG
aatactgatgtctyccgaaaaacacagccccaagggagtcgagacgwtgtaccaggtagaataaggcacaggggagccgcttgacaaatcagacgacggcagccggcctgcctgcccggtatgtggccaaatatgggcgaggccaaggttggggtgtgaaagtgcgtgacgtttacacccacgtgggcgtctgtgcacgtgcgtgtgtgcgtgtgagctgcctgtgggcatctgcagaagcagacattcttcatggctaaacaaaaacctcacgttttgggttccagggtgatgccagcgagttgtgtttctgagagacgaaggaagccttccttccaggtttccacgtggagcagtgcctctctgcgtggttcctggcagcaggggatgccaggc

SEQ ID NO: 119 - DNA, 193 bp, Homo Sapiens
  Brain
  sig_peptide 143..187: Von Heijne matrix; score 4.60; seq FLYLKSVFDVSLG/AR
atggagatccataacatgatcctacatgaatgtttcaatattgtattcctgtaagttacttttacattgacagttctgaaattcatgttgagtgttaattaggcaggaaatcagaagggaggttttgtagaaggtcgtatccatgggttttttatatttgaaaagtgttttcgatgtatcattgggggcaagg

SEQ ID NO: 120 - DNA, 460 bp, Homo Sapiens
  Brain
  sig_peptide 254..436: Von Heijne matrix
  score 4.60
  unsure 8: seq LLLLHGGGHSALS/WA; position 8 of amino acid sequence; Xaa = Lys,Arg
aagtttacggagccggtgggcggtaggcggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggascaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagctarg

SEQ ID NO: 121 - DNA, 275 bp, Homo Sapiens
  Brain
  sig_peptide 207..245: Von Heijne matrix; score 4.60; seq MIFLLYLLPSSEE/RR
aaacagacaggtatggagtctgggtggggccacgtgtaccctcccatccttagaaagagtgtgacaccaagggacagatgctggcgtasgcgggttttgttttggagggttttttgtttgtttttacaaaaattaagatatttctgagtttattatgaggcttttagttttacaatcatactaaaagataattgttcctctataaaatgattttccttctgtacctcttgccttcttctgaagaaaggagaaaattgctttttagtccccacagg

SEQ ID NO: 122 - DNA, 445 bp, Homo Sapiens
  Brain
  sig_peptide 236..418: Von Heijne matrix; score 4.60; seq LLLLHGGGHSALS/WA
gcggtaggcgggtgctacgggtagctgggtgctgtccaaaggcgacagggcgtcgttaggggagcgagtcgtgaccggttgggccacactcaacgtgggacgaagcttcgcctactgtttgactacgtgcgtgcagcctcccctcgatgtcggccctcgaaaagagcatgcacctcggccgccttccctctcgcccacctctacccggcagcgggggcagtcagagcggascaagatgcgaatgggccctggaagaaagcgggacttttcccctgttccttggagtcagtattttgagtccatggaagatgtagaagtagagaatgaaactggcaaggatacttttcgagtctacaagagtggttcagagggtccagtcctgctccttctgcatggaggaggtcattctgccctttcttgggctgtgttcacggcagcgacatgg

SEQ ID NO: 123 - DNA, 138 bp, Homo Sapiens
  Brain
  sig_peptide 49..96: Von Heijne matrix; score 4.50; seq LLNLISILASIPS/QF
atatactgaattaagtgtctcttggtaatacaggctcttatcaaacccatgctgagcctattaaatctcatttcaatcttagcaagtattcccagtcaatttaaaccacagtttagcaagctgccactctcaggccgg

SEQ ID NO: 124 - DNA, 94 bp, Homo Sapiens
  Brain
  sig_peptide 11..85: Von Heijne matrix; score 4.50; seq LMLLWPVHPLLVG/HR
aagattcatcatgggcaccacctccaacatggtcaccaccatccatctcatgttgctgtggccagtgcatccattactggtgggccaccgcggg

SEQ ID NO: 125 - DNA, 481 bp, Homo Sapiens
  Brain
  sig_peptide 41..343: Von Heijne matrix; score 4.40; seq ISHILAFFAASDG/IV
aagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcaga

SEQ ID NO: 126 - DNA, 197 bp, Homo Sapiens
  Brain
  sig_peptide 3..50: Von Heijne matrix; score 4.40; seq GLFSLLPHPPCVG/RV
agatggatgcaggcttattttctctgcttccccatcctccatgtgttggcagggtgctgccacagtctaggtatcatctgcatccaagatcacctttggtagaagatacctgtttcttccagaggcttaaaaaaattttaaataaaataggaaaccttttccattcaacaaagtccctttgtgtctcacttgccccg

SEQ ID NO: 127 - DNA, 121 bp, Homo Sapiens
  Brain
  sig_peptide 65..106: Von Heijne matrix; score 4.40; seq LITLTYLIQGESA/RT
atttaataacttaaaaattggccaattttatttttagaaaagctctgcatcatcctgtgtttagatgttaattacgctgacttacctaatccagggtgagtcagcacgaaccacgttcgag

SEQ ID NO: 128 - DNA, 238 bp, Homo Sapiens
  Brain
  sig_peptide 146..223: Von Heijne matrix; score 4.40; seq RVQCLCAIPFAFS/LT
aaaatatgtcttcagctctaatccattatcactcagatcattctaaccttttccccttgcttatctataactttccacttcaacagtgagaaacctggcttccatatctgtcatccataaatgtacgtatttaattccagtacacatgtatactggtttcagaatagaagcaactttattaactagagtgcagtgcttatgtgcaattccttttgcctttagtcttacaggcatccgg

SEQ ID NO: 129 - DNA, 419 bp, Homo Sapiens
  Brain
  sig_peptide 252..392: Von Heijne matrix; score 4.40; seq ISHILAFFAASDG/IV
aagcggaccacctgggtgctgtcgtagttggaggtggcctgaggagctcagttccctcagcgcccgtagtttcggcggagtctgcgcgatgggcgacccggaaaggccgggaagcggccgggctggatcaggatgagagatcatcttcagacaccaacgaaagtgaaataaagtcaaatgaagagccrstcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgc

SEQ ID NO: 130 - DNA, 255 bp, Homo Sapiens
  Brain
  sig_peptide 112..195: Von Heijne matrix; score 4.30; seq FLGLAAMASPSRN/SQ
aattacgatgtkktgtgtgcttgtgcaaatacaggacggttcctgaaatgtgtctctgagcgttcttaactgtgtgtraggaattsmtgcgcgtacacgtggtgggtcattatgctgctgcacctgtgtagtgtgaagaatctgtaccagaacaggtttttaggcctggccgccatggcgtctccttctagaaactcccagagccgacgccggtgcaaggagccgctccgatacagctacaaccccgaccagggg

SEQ ID NO: 131 - DNA, 287 bp, Homo Sapiens
  Brain
  sig_peptide 123..176: Von Heijne matrix; score 4.30; seq WTCLKSFPSPTSS/HA
aagagcatcctgcgccccggcgcggggccctgcggtagcctcaggcccctcccctggacccgccgcagagccagtgcagaatacagaaactgcagccatgaccacgcacgtcaccctggaagatgccctgtccaacgtggacctgcttgaagagcttcccctccccgaccagcagccatgcatcgagcctccaccttcctccatcatgtaccaggctaactttgacacaaactttgaggacaggaatgcatttgtcacgggcattgcaaggtacattgaccaggcag

SEQ ID NO: 132 - DNA, 224 bp, Homo Sapiens
  Brain
  sig_peptide 6..104: Von Heijne matrix
  score 4.30
  unsure -24: seq LLGWGLNLTLGQG/AP
  position -24 of amino acid sequence
  unsure 26: Xaa = Lys,Met; position 26 of amino acid sequence; Xaa = Cys,Gly
aaaggatggaggatctctttagcccctcaattawgccgccggcgcccaacatttccgtgcccatcttgctgggctggggtctcaacctgaccttggggcaaggagcccctgcctctgggccgcccagccgccgcgtccgcctggtgttcctgggggtcatcctggtggtggcggtggcakgcaacaccacagtgctgtgccgcctgtgcggcggcggcgggccg

SEQ ID NO: 133 - DNA, 347 bp, Homo Sapiens
  Brain
  sig_peptide 183..338: Von Heijne matrix; score 4.10; seq VMLETCGLLVSLG/HP
agggacttccggcctcgctggcgtggacgtttgtggtggggcgtgttggtccgcgctctcagaactgtgctgggaaggatggtagggcgactggggctcacctccgcaccgttgtaggacccggggtagggttttgagcccgtgggagckgccccacgcggcctcgtcctgccaacggtcggatggcggagacgaaggacgcagcgcagatgttggtgaccttcaaggatgtggctgtgacctttacccgggaggagtggagacagctggacctggcccagaggaccctgtaccgagaggtgatgctggagacctgtgggcttctggtttcactagggcatcctcgg

SEQ ID NO: 134 - DNA, 432 bp, Homo Sapiens
  Brain
  sig_peptide 298..336: Von Heijne matrix; score 4.10; seq MLILSQNIAQLEA/QV
aattgarrtgtttgataactgtcactttagggtttcaaccaaaaccttgactttatcatcttgttatacatttttcaaaatgaggttagagatcaggggaatgaataggagagaagtacatatttcagttcactgggcataggtgaatagaggaaggagaaaatgaacatacccaatccacagagaaatggctcacagagcccagtgactatgctgagacgctattaattcaagaaagttttagtatttgatttgtcaaatgacattattgtttaggacttttattttcccttacagatgttgatcttgtctcagaatattgcccaactggaggcccaggtggaaaaggttacaaaggaaaagatttcagctattaatcaactggaggaaaattcaaagccagctggcttctcgggaaaatggatgtcacaa

SEQ ID NO: 135 - DNA, 380 bp, Homo Sapiens
  Brain
  sig_peptide 90..152: Von Heijne matrix
  score 4.10
  unsure 2: seq GLWAHSWTCSCSA/AX; position 2 of amino acid sequence; Xaa = Leu,Val
aattcacttcacctggagttgagccaagattctctttactccaaagccagcactccttctgagaacaggactttgatttggatggacggatgttgctgggggcctcagcacagggtctttgggctcacagctggacatgcagctgttcagcggcastgcggtctgtccacccaggcggagactggatgcaacagtttcaggcggggttcctccctccccaggtgcctgcccacctctcccttacatgggatgtctctcttcttcctccttgcctggtccctaaagcacttgagtttgtggttcattttttaaaaaatgatatattttatttaacccagtatattaaaaatgtcatttcagaatgtacgttttcctttttt

SEQ ID NO: 136 - DNA, 212 bp, Homo Sapiens
  Brain
  sig_peptide 9..53: Von Heijne matrix; score 4.10; seq APLELSCWGGGWG/LP
agcgcaagatggcggcccccttggaactcagttgctggggaggcggctggggactcccatcggttcacagcgagtccctggtggtgatggcttatgccaaattttctggtgcacccttgaaagtcaatgtgatagataacacctggagaggttcaagaggcgatgtaccaattttgacaactgaagacgacatggtttctcagccagcaagg

SEQ ID NO: 137 - DNA, 432 bp, Homo Sapiens
  Brain
  sig_peptide 226..285: Von Heijne matrix
  score 4.10
  seq LGFLNCYIAVARS/GG
  misc_feature 8: n=a, g, c or t
  unsure -18: position -18 of amino acid sequence; Xaa = Glu,Gly,Val
aagggamnsacccaggctgcgggacsggtgcaggctgcggcgctgacggcctctgctccttccgcgggtttccgactccctgccctagattttctgcttagcgacttggggtcccctctcgtttgcttctggtaggagtcgcaatcccakbagcaatagcccagaagaggacacggttcccgtaccgaaggttcagtaccagcagcccgaccatcacgcggcgggatgtctgdrgttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaag

SEQ ID NO: 138 - DNA, 229 bp, Homo Sapiens
  Brain
  sig_peptide 101..157: Von Heijne matrix
  score 4.10
  seq FVVFSTMFTASSP/GE
  misc_feature 192: n=a, g, c or t
  unsure -14: position -14 of amino acid sequence
  unsure 12: Xaa =  * ,Ser,Tyr
  position 12 of amino acid sequence
  unsure 24: Xaa =  * ,Cys,Phe,Leu,Ser,Trp,Tyr; position 24 of amino acid sequence; Xaa = Arg,Trp
agatgaatatttgatacccacagtagaacttctttmmgaacttctttcacaatwggagttaatcttctaaagccccgccactgcttcatcaactaagtttatggaatattctaaatmmtttgttgtcttttcaacaatgttcacagcatcttcaccaggagaagactttccccccttcttttcacagatgtnsagattgtcaagaaactactttccttgcccaccrwgg

SEQ ID NO: 139 - DNA, 328 bp, Homo Sapiens
  Brain
  sig_peptide 113..232: Von Heijne matrix
  score 4.10
  seq LPFRLPWASTATA/RC
  misc_feature 264: n=a, g, c or t
  unsure 11: position 11 of amino acid sequence; Xaa = His,Leu,Pro,Arg
aacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcncctgatgctctgtatcccaacggggttcacccctacccagcccagagccccgcggccccctggg

SEQ ID NO: 140 - DNA, 217 bp, Homo Sapiens
  Brain
  sig_peptide 53..166: Von Heijne matrix
  score 4.00
  unsure -34: seq WALGLKFLSSSSQ/NF
  position -34 of amino acid sequence
  unsure -31: Xaa = Ser,Thr; position -31 of amino acid sequence; Xaa = Asp,Glu,Val
aacaggagacttgggaaggaccaatggtaatttaagtggctcttaaaaagtcatgcaacatgtwwctggacacgwwcctgatcctattgcgataatgtatgtgtgccctccctgtgggcacaccacctgggcattaggactgaaattcctgagttcttcctctcaaaatttctgtgcaccagtattattcctcattttacatacaggaggccaacgg

SEQ ID NO: 141 - DNA, 202 bp, Homo Sapiens
  Brain
  sig_peptide 44..133: Von Heijne matrix; score 4.00; seq AGFLKCLLLSSLQ/SY
ataatagtgttatttcagtgcatgatttttgcctttgagagacatgggttgggaaatgacatgtattaagtcttttttctgggccaggtctcatgctgggttcttgaaatgcctcctgttgtcttcattacagtcctacaaggaggctgctgttatcttccctcttactgatttgctcaaactgaaagattatggtgaatgg

SEQ ID NO: 142 - DNA, 361 bp, Homo Sapiens
  Brain
  sig_peptide 248..355: Von Heijne matrix; score 4.00; seq VQLSFAATTPVLA/DK
aagttgggagaggagctgctggttgaagtgaaggtgaggagctcagtgcttctttcactgccctatctgctgggctttacgcccctgaggggctgactgtaaaaaactctaagctgatccagcccccaaaattcacctttggtgagctggaaagtccatctatttgggacgcgaatcatgtcagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataag

SEQ ID NO: 143 - DNA, 216 bp, Homo Sapiens
  Brain
  sig_peptide 145..192: Von Heijne matrix; score 4.00; seq ITWSLLFLYQCSL/HF
acacattacctcttttcattttagacaggttaattagtgtgtatttccatagttgtcttttacctcaagaaataatcatttctttaggtaattattttaatggcttgccattttgtatgattgttcttgcaaacatttctatttatgcattttataacatggagcttactatttttataccagtgctcgcttcattttatcattatcaaggccggg

SEQ ID NO: 144 - DNA, 378 bp, Homo Sapiens
  Brain
  sig_peptide 256..363: Von Heijne matrix; score 3.90; seq CWPSVASPSSSWS/SP
aaagtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagt

SEQ ID NO: 145 - DNA, 321 bp, Homo Sapiens
  Brain
  sig_peptide 172..282: Von Heijne matrix; score 3.90; seq PGPSLRLFSGSQA/SV
aagggtctccatgacaaccggcctggccggctagcagtgctctgctcacttggctgcgaggagcgccacgaaaggtcagaggaaggagctgtgggaagctcgcagcaggtatcggagcttaagccagtggatttgggggccctgggctccctagccggctgcggtgtgagaatggagtgggcaggaaagcagcgggactttcaggtaagggcagctccgggctgggatcatttggcctcctttcctggcccttctctccggctgttttctgggagtcaggcgagtgtctgtagtctctgctcggggtttggggctcaggaa

SEQ ID NO: 146 - DNA, 278 bp, Homo Sapiens
  Brain
  sig_peptide 78..257: Von Heijne matrix
  score 3.90
  unsure 6: seq AKVVSLSLQTSSA/HH; position 6 of amino acid sequence; Xaa = His,Ile,Leu,Asn,Arg,Ser
aagaacacaaaaagctacagaaggtccaggctactgaaaagcatcaagaccaagctgttgtaagtcaaactgcttttatgattgcattctttgatgaagacaatcccagaaaaagaaggtcgtattcttttactcaaagtgcgggaatcttgtgtcaggaaactacatattcaacaccacatacaaaacttgagaaagcaaagtctccaacagcagatgccaaagtggtttctttgtctttacagactagctctgcgcatcacagaggggggmdtggt

SEQ ID NO: 147 - DNA, 349 bp, Homo Sapiens
  Brain
  sig_peptide 89..232: Von Heijne matrix
  score 3.90
  seq ALFCTLPCPVERG/QQ
  misc_feature 249,251..253: n=a, g, c or t
  unsure -43: position -43 of amino acid sequence
  unsure -37: Xaa = Ile,Thr
  position -37 of amino acid sequence
  unsure -29: Xaa = Leu,Arg
  position -29 of amino acid sequence
  unsure 6: Xaa = Lys,Gln
  position 6 of amino acid sequence
  unsure 7: Xaa = Ile,Lys,Met,Asn,Arg,Ser,Thr
  position 7 of amino acid sequence
  unsure 8: Xaa = any one of the twenty amino acids; position 8 of amino acid sequence; Xaa = Lys,Met,Thr
aaattttcttaaattagcagtctaatgtgttctaaagagcagctccactcagatctcttcttaagggttgcatttcatcacagtataaatgggcaaatccatcayttccctctgctcagtgckcttgaargcgagattgaagggmmaattagaagctgttcatttgtgcttgcgggctcagaagcgtcgcactgctttgttttgtactctaccgtgtcctgttgaaaggggtcaacaagtgccgggganvnnnahgaggctgaggctggcgtcaccttccgttgctaaggtgttccagtgttttctctcaaaactctgtgtttggaacatcaaggatggattatcccgg

SEQ ID NO: 148 - DNA, 210 bp, Homo Sapiens
  Brain
  sig_peptide 52..96: Von Heijne matrix
  score 3.90
  unsure 1: seq LHMTLFRVPFTFS/XF; position 1 of amino acid sequence; Xaa = Phe,Val
acacaaaggaaaatggcagggatatgaatttctttcccagcttttatatagatgtgcctgcatatgacactctttagagttcctttcactttttctkttttttggaagggggcggggaggcaggaggagtgcagttttaagcctagcctatactactacaaacttattatggtacttaaaattgcactcctcctgtccccgccccccaag

SEQ ID NO: 149 - DNA, 143 bp, Homo Sapiens
  Brain
  sig_peptide 75..116: Von Heijne matrix; score 3.90; seq LNILKTLTSAALP/SP
aatacaccttaaactttactactttttataaacggtaggaaaggatatactgatgttgtgggtattacaaggtaatgctgaacattctgaagaccttaacttctgctgctcttccctccccctccccccgccccaacaagagg

SEQ ID NO: 150 - DNA, 176 bp, Homo Sapiens
  Brain
  sig_peptide 24..143: Von Heijne matrix; score 3.90; seq SPLLCLYHPPVYT/ST
agtaatcccaggcgttcgccctcatgcgggccagggtttggcctcgctcccacgggatccctgtgccttcctttctctctaagagcagcctcagtcatacaccatcacctctcctctgtctataccatcctcctgtctacaccagcaccactaccccatctataccaccacgtctg

SEQ ID NO: 151 - DNA, 414 bp, Homo Sapiens
  Brain
  sig_peptide 262..369: Von Heijne matrix
  score 3.90
  unsure -20: seq SLCLSLLIPGPKP/LV; position -20 of amino acid sequence; Xaa = His,Leu,Gln,Arg
aaagtaggaaatggctgcttcacccaggaggcaccaagatgcccgtgtgtggctctactggtgatgccctggtcttcattgaaaaggccagcacccgttacgtggtcagcacagacgttgccgtgaatgaggattccttcctacagatagacttcgctgcctcctgctcagtcacagactcttgttatgcgattgaattggaatactcagtagatcttggattgtcatggcacccattggtaagggactgtctgcctaccaatgtggaatgcagtcgctatcatctgcaacggatcctggtgtcagacacdwtcaacaagtggactagaatcactctgcctctccctccttataccaggtcccaagccactcgtttccgttggcatcaaccagctccttttgacaagcagcaga

SEQ ID NO: 152 - DNA, 171 bp, Homo Sapiens
  Brain
  sig_peptide 103..144: Von Heijne matrix
  score 3.90
  unsure 8: seq LRLGLFKISWARC/LS; position 8 of amino acid sequence; Xaa = Leu,Pro,Arg
aaaaattatttctgcttaaacaacagtttcaaatatttctcttttgaagacaaaattggtttagtttcagcaatgtattgatataattttacatttttttaaatgttgaggctgggtttatttaagattagctgggctcgctgcctatcatatagtaaaacccagcbcgaa

SEQ ID NO: 153 - DNA, 262 bp, Homo Sapiens
  Brain
  sig_peptide 80..187: Von Heijne matrix; score 3.90; seq VVEILPYLPCLTA/RD
aggggtaccgagtctcgtttcctctcagtccatccacccttcatggggccagagccctctctccagaatctgagcagcaatgccgtttgctgaagacaagacctataagtatatctgccgcaatttcagcaatttttgcaatgtggatgttgtagagattctgccttacctgccctgcctcacagcaagagaccaggatcgactgcgggccacctgcacactctcagggaaccgggacaccctctggcatctcttcaatacc

SEQ ID NO: 154 - DNA, 165 bp, Homo Sapiens
  Brain
  sig_peptide 46..153: Von Heijne matrix; score 3.80; seq GTDSLSFLPPCPC/CP
aatcatgaaatccttgcaactcattaagtttcctgtttgctgtagatgccaggaagctcagggctcagatttatatgtaagtccaggaaccatcctcagtttgggagtttcagtggaactgactccctttccttcctaccaccctgcccctgttgcccggctgcg

SEQ ID NO: 155 - DNA, 261 bp, Homo Sapiens
  Brain
  sig_peptide 64..234: Von Heijne matrix
  score 3.80
  unsure -11: seq QLXLVMEFCGAGS/VT; position -11 of amino acid sequence; Xaa =  * ,Trp
acatacgggcaagtttataagggtcgtcatgtcaaaacgggccagcttgcagccatcaaggttatggatgtcacaggggatgaagaggaagaaatcaaacaagaaattaacatgttgaagaaatattctcatcaccggaatattgctacatactatggtgcttttatcaaaaagaacccaccaggcatggatgaccaactttgrttggtgatggagttttgtggtgctggctctgtcaccgacctgatcaagaacacaggg

SEQ ID NO: 156 - DNA, 126 bp, Homo Sapiens
  Brain
  sig_peptide 49..120: Von Heijne matrix; score 3.80; seq KLFLVFLLNICKG/IV
atctctagaaagaagaaggcatgctacaaataggaaggaattgtaataatgatatttggcctctactttgtcttagctgttaaactgtttttagtatttttgttaaatatttgcaaagggatcgtg

SEQ ID NO: 157 - DNA, 383 bp, Homo Sapiens
  Brain
  sig_peptide 246..347: Von Heijne matrix; score 3.60; seq IKCSSWISSLASG/IP
agtattgagttggaagtgcccattggacatcacgtggagatgaaataggcaattaaaatattcagatcttgggttcaggagcgagacccatgtctgaaatataaacttgctcactgtcagcctgtgatggtctttgtgagacatagaatgaatattaataaagaggtgtaaggactgatcctgggatcatccacagtaaggctgggggaagaggagacctggcaaaggaatcaaagacatgatccatgaggaagaagcgagtrgaagaactaatagtgtttccaggagaagtaacttctttctcctccatcaagtgctcctcttggatttcttccctggcttctggaataccacactctcttggattctcccttcccccaggg

SEQ ID NO: 158 - DNA, 427 bp, Homo Sapiens
  Brain
  sig_peptide 257..340: Von Heijne matrix
  score 3.60
  seq ACLFSXFLAVSRH/PN
  misc_feature 350: n=a, g, c or t
  unsure -8: position -8 of amino acid sequence
  unsure 4: Xaa = Leu,Val; position 4 of amino acid sequence; Xaa =  * ,Ala,Cys,Asp,Glu,Gly,His,Lys,Asn,Pro,Gln,Arg,Ser,Thr,Trp,Tyr
aagaaccctttttatagataggtcttgtctggatttgtgcacgtggatttataatgagagattttctagttgtttttggttctcctcctcctcctcctcctttdhcctccttctvttcctccttttcttcctccttwtcttctaaaacctctaatctcttattccctctaatgtctgaccaaagtactgctgtctgagacattggaggcatactgtgctcctcttcttccctccctgtggagaagccttaagttatatgccttcatccagtcttgcagagttgtgtctaatgcagcaagatgcctgcctgttttctktgttcctagcwgtctccaggcatccaaactatnvktgttccatcagtactaagggtgaggtgagagagaaactagttccttggataacacaccaaatggccagaatgttg

SEQ ID NO: 159 - DNA, 158 bp, Homo Sapiens
  Brain
  sig_peptide 21..140: Von Heijne matrix; score 3.60; seq LQMRMQLPCLVLG/EE
aattttcagtaggaaacattatggatctgtggagctgcttatttccagtgatgctgatggagccatccaaagggctggaagattcagagtggaaaatggctcttcagatgagaatgcaactgccctgcctggtacttggcgaagaacagacgcttggg

SEQ ID NO: 160 - DNA, 319 bp, Homo Sapiens
  Brain
  sig_peptide 209..289: Von Heijne matrix; score 3.60; seq AVPLPTTSTLTSA/ST
aagttctgtgggctctattcggccatattaataaagagaaagggaaggctgachgtccttcgcctccgcccccacatacacaccccttcttcccactccgctctcacgactaagctctcacgattaaggcacgcctgcctcgattgtccagcctctgccagaagaaagcttagcagccagcgcctcagtagagacctaagggcgctgaatgagtgggaaagggaaatgccgaccaattgcgctgcggcgggctgtgccattacctacaacaagcacattaacatcagcttccacaggtttcctttggatcctaaaagaa

SEQ ID NO: 161 - DNA, 91 bp, Homo Sapiens
  Brain
  sig_peptide 14..67: Von Heijne matrix; score 3.60; seq IQKSSGLFCPSQA/QS
agaaaatggaaaaatgaccccaaaggcaattcagaaatcatcagggctcttctgcccatcacaggcccagagcgcaagacccgcagaaaag

SEQ ID NO: 162 - DNA, 364 bp, Homo Sapiens
  Brain
  sig_peptide 56..271: Von Heijne matrix; score 3.60; seq CTSLLQLYDASNS/EW
aaactcgctgggctccaaaagaaacactggcttctctccttcagctccaggctagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgctggg

SEQ ID NO: 163 - DNA, 185 bp, Homo Sapiens
  Brain
  sig_peptide 129..173: Von Heijne matrix
  score 3.60
  seq LVSFFLELNVLQQ/WP
  misc_feature 72,74: n=a, g, c or t
agtagaccgcgcactggaaggcgtgcgcgcaggtgtgcgtgaccatgtgcttgaaacggcagtagcgcasrngnaaggatcgccatcacacggcgcactggtgcggcttctcccccgagtggacgaacatgtgcttggtgtcgtttttccttgagctgaacgtcttgcaacagtggccggcaggg

SEQ ID NO: 164 - DNA, 234 bp, Homo Sapiens
  Brain
  sig_peptide 103..141: Von Heijne matrix; score 3.60; seq MRSLACLTPCGHA/GS
atacctcttccagttgggaaaaaatggacttaaaatgtcccatgtccaggctgacctggatgatgacagttggttgatgagttaatttgaacatgagcagaaatgaggtcacttgcctgcctgactccatgtggccatgctggctccaggttgcaaagttctttgagcaagtaccttgtcttgcctaatctcgaatgtctgttctttttatttcttatctcaaataggcgctgg

SEQ ID NO: 165 - DNA, 315 bp, Homo Sapiens
  Brain
  sig_peptide 70..108: Von Heijne matrix; score 3.50; seq MHLLSNWANPASS/RR
aagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaaga

SEQ ID NO: 166 - DNA, 415 bp, Homo Sapiens
  Brain
  sig_peptide 62..133: Von Heijne matrix
  score 3.50
  seq FAMLHSVWRLIPA/FR
  misc_feature 407: n=a, g, c or t
  unsure 84: position 84 of amino acid sequence
  unsure 92: Xaa = Phe,Ser; position 92 of amino acid sequence; Xaa =  * ,Gly,Arg
aaaggagccaacykcacagtacatttctctttgtcatgaattgcatactttgttccaagtcatgtggtctggaaagtgggcgttggtctcaccatttgctatgctacactcagtgtggagactcattcctgcctttcgtggttacgcccaacaagacgctcaggaatttctttgtgaacttttagataaaatacaacgtgaattagagacaactggtaccagtttaccagctcttatccccacttctcaaaggaaactcatcaaacaagttctgaatgttgtaaataacatttttcatggacaacttcttagtcaggttacatgtcttgcatgtgacaacaaatcaaataccatagaacctttctgggacttgtcattggagtytccagaaaggtatcaatgcagtngaaaaggg

SEQ ID NO: 167 - DNA, 252 bp, Homo Sapiens
  Brain
  sig_peptide 130..189: Von Heijne matrix; score 3.50; seq KFCLICLLTFIFH/HC
aagacgcgccggtttctgcgacgcagttagcgcagtctgctttggtgaatacacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcaaggg

SEQ ID NO: 168 - DNA, 436 bp, Homo Sapiens
  Brain
  sig_peptide 290..361: Von Heijne matrix; score 3.50; seq ALSLFYTADTSHG/SE
atatttcttgtcaacagtattgaaatgtaatatgtatgtgttcatgtatgagmaatttttactccacacaggtgtttcagtagagtggggcaggaaaagagatctcttcgatttctttcaggcctgaggcttttgtgaaatgcgtcascccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggwagagaaggragtaacccaaagtactactcattt

SEQ ID NO: 169 - DNA, 343 bp, Homo Sapiens
  Brain
  sig_peptide 65..112: Von Heijne matrix
  score 12.50
  misc_feature 104..336: seq FVVLLALVAGVLG/NE; blastn; identity 96; region 1..233
  id H07998
  misc_feature 110..336: est; blastn; identity 96; region 1..227
  id W37530
  misc_feature 110..336: est; blastn; identity 96; region 1..227
  id R79812
  misc_feature 110..336: est; blastn; identity 96; region 1..227
  id N24900
  misc_feature 110..336: est; blastn; identity 96; region 1..227
  id R34849
  est
  misc_feature 335,337,341: n=a, g, c or t
  unsure 70: position 70 of amino acid sequence
  unsure 75: Xaa = Ser,Tyr
  position 75 of amino acid sequence
  unsure 77: Xaa =  * ,Cys,Gly,Arg,Ser,Trp; position 77 of amino acid sequence; Xaa = Gly,Arg,Trp
atgtcgcccgtgtcccgccggcccgttccgtgtcgccccgcagtgytgcggccgccgckkcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggcttctctgtgaaagaagacctttcttggccaggactcgcagtgggtaacctgtttcatcgtcctcgggctagcgtcatggtgatggtgaagggagttaacaactmccctctacccccangntggngg

SEQ ID NO: 170 - DNA, 234 bp, Homo Sapiens
  Brain
  sig_peptide 40..87: Von Heijne matrix
  score 10.10
  misc_feature 111..209: seq LLLQLAVLGAALA/AA; blastn; identity 90; region 1..99
  id N50844
  misc_feature 186..232: est; blastn; identity 93; region 75..121
  id N50844
  misc_feature 111..209: est; blastn; identity 90; region 1..99
  id N29905
  misc_feature 186..232: est; blastn; identity 93; region 75..121
  id N29905
  misc_feature 186..232: est; blastn; identity 93; region 75..121
  id N62597
  misc_feature 186..232: est; blastn; identity 93; region 76..122
  id R80247
  misc_feature 186..232: est; blastn; identity 93; region 76..122; id H03409; est
aagaggtgcgggattgggcgggctgccacggcatggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccagg

SEQ ID NO: 171 - DNA, 386 bp, Homo Sapiens
  Brain
  sig_peptide 135..284: Von Heijne matrix
  score 9.80
  misc_feature 52..228: seq LLRLLQLVSTCVA/FS; blastn; identity 94; region 1..177
  id AA074050
  misc_feature 266..387: est; blastn; identity 99; region 218..339
  id AA074050
  est
  misc_feature 365: n=a, g, c or t
agcggccgcagccagccaggccgcgcmmgggacgactgcagagcgcggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctcngtgaccctgatcatcctcatc

SEQ ID NO: 172 - DNA, 326 bp, Homo Sapiens
  Brain
  sig_peptide 111..164: Von Heijne matrix
  score 9.20
  misc_feature 147..290: seq VFLCSLLAPMVLA/SA; blastn; identity 99; region 57..200
  id W40499
  misc_feature 90..151: est; blastn; identity 98; region 1..62
  id W40499
  misc_feature 100..319: est; blastn; identity 99; region 46..265
  id R88049
  misc_feature 100..319: est; blastn; identity 99; region 56..275
  id T08712
  misc_feature 100..319: est; blastn; identity 99; region 32..251
  id H38484
  misc_feature 147..319: est; blastn; identity 98; region 65..237
  id T65344
  misc_feature 102..151: est; blastn; identity 100; region 21..70; id T65344; est
agactcttggggactgggctgaggacggggtggtactgctcctggcagggccagaggtggatggggcttgaaaagggggttcaaggcagcagmtctatggttcagacgccatggagttggtgctggtcttcctctgcagcctgctggcccccatggtcctggccagtgcagctgaaaaggagaaggaaatggacccttttcattatgattaccagaccctgaggattgggggactggtgttcgctgtggtcctcttctcggttgggatcctccttatcctaagtcgcaggtgcaagtgcagtttcaatcagaagccccgcaacaga

SEQ ID NO: 173 - DNA, 376 bp, Homo Sapiens
  Brain
  sig_peptide 167..304: Von Heijne matrix
  score 7.90
  misc_feature 74..344: seq LLGLLSAEQLAEA/SV; blastn; identity 96; region 73..343
  id H95186
  misc_feature 25..86: est; blastn; identity 93; region 25..86
  id H95186
  misc_feature 138..377: est; blastn; identity 100; region 1..240
  id N40665
  misc_feature 203..308: est; blastn; identity 95; region 230..335; id W25197; est
aacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcatcctgtgtgcagctcttaggtctcctttctgcagaacaacttgcagaagcatcggtgctgatactcttcaataaaatcgacctaccctgttacatgtccacggaggagatgaagtcattaatc

SEQ ID NO: 174 - DNA, 277 bp, Homo Sapiens
  Brain
  sig_peptide 107..247: Von Heijne matrix
  score 7.90
  misc_feature 59..278: seq LLLPRVLLTMASG/SP; blastn; identity 97; region 28..247
  id R78970
  misc_feature 59..210: est; blastn; identity 92; region 29..180
  id R64509
  misc_feature 196..278: est; blastn; identity 96; region 167..249
  id R64509
  misc_feature 59..210: est; blastn; identity 92; region 44..195
  id H85714
  misc_feature 196..278: est; blastn; identity 96; region 182..264
  id H85714
  misc_feature 59..278: est; blastn; identity 96; region 36..255
  id H52756
  misc_feature 59..278: est; blastn; identity 96; region 5..224
  id H49758
  est
  misc_feature 31,33,58: n=a, g, c or t
atcacgtggcrgccacccaggkamgaagarnanvtcttcctggggttvhttctccganrtgacgtsysgcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctgg

SEQ ID NO: 175 - DNA, 388 bp, Homo Sapiens
  Brain
  sig_peptide 113..232: Von Heijne matrix
  score 7.90
  misc_feature 180..390: seq SLLLLFGGQFASS/QE; blastn; identity 98; region 134..344
  id H08480
  misc_feature 115..185: est; blastn; identity 100; region 1..71
  id H08480
  unsure -14: est; position -14 of amino acid sequence; Xaa = Glu,Gly,Lys,Arg
agcagagcttccgcttccggcccttcaggctctgtctctgtggagactgggctttgggaggkagaaagagggacctagcgcgggccgcgcaggcgcacggtgggcagctgcaatggcgctgtcgtgtacccttaacaggtatctgctcctcatggcgcaggagcatctggagttccgcctgccggaaatarrgtctttgcttttgctttttggaggtcagtttgccagcagtcaagaaacttatggaaagtcaccattttggattcttagcattccctctgaagatattgcaagaaatttgatgaaacggacagtgtgtgccaagtctatatttgaactatggggtcatggacaatctcctgaggagctgtacagttctcttaaaaac

SEQ ID NO: 176 - DNA, 311 bp, Homo Sapiens
  Brain
  sig_peptide 39..197: Von Heijne matrix
  score 7.10
  misc_feature 112..309: seq IAVGLGVAALAFA/GR; blastn; identity 97; region 69..266
  id AA149265
  misc_feature 41..86: est; blastn; identity 97; region 1..46
  id AA149265
  misc_feature 110..309: est; blastn; identity 97; region 53..252
  id W39570
  misc_feature 56..86: est; blastn; identity 96; region 2..32
  id W39570
  misc_feature 110..309: est; blastn; identity 97; region 55..254
  id N41332
  misc_feature 53..86: est; blastn; identity 97; region 1..34; id N41332; est
aactgccgcggcgccttgagtctccgggccgccttgccatggctgcccgtggtgtcatcgctccagttggcgagagtttgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacggagg

SEQ ID NO: 177 - DNA, 384 bp, Homo Sapiens
  Brain
  sig_peptide 292..375: Von Heijne matrix
  score 6.60
  misc_feature 43..87: seq VLGXLFLGGLCRG/WD; blastn; identity 100; region 8..52
  id W32101
  misc_feature 89..129: est; blastn; identity 100; region 53..93
  id W32101
  unsure -10: est; position -10 of amino acid sequence; Xaa = Glu,Val
aagagccgcgttyagtctatcgctgcggttgcgagcgctgtagggagcctgtgctgtgccgcgcagttaggcagcagcagccgcggagcagtagccgccgtgggagggagccatgaagcattacgaggtaagaagcgagaaacaggggccgtgtggccactgctgacccattctttttccttctttgcgggaccacgggaccccactttctggtcctgtgccccgaaggaagakccagacggcgcaggcgcagtgggcaagcgttgcgccccgggccactcgtaaattccaatgcgcatgtgcgcaggaagtatttataaatctgcaacccaggctgttttgggggwactttttcttgggggtctctgcaggggctgggacgct

SEQ ID NO: 178 - DNA, 425 bp, Homo Sapiens
  Brain
  sig_peptide 186..419: Von Heijne matrix
  score 6.30
  misc_feature 73..317: seq TLIMLLSWQLSVS/SV; blastn; identity 97; region 1..245
  id HUM506F10B
  misc_feature 314..376: est; blastn; identity 98; region 243..305
  id HUM506F10B
  misc_feature 63..193: est; blastn; identity 99; region 1..131
  id AA056148
  misc_feature 314..401: est; blastn; identity 95; region 254..341
  id AA056148
  misc_feature 277..317: est; blastn; identity 97; region 216..256
  id AA056148
  misc_feature 397..426: est; blastn; identity 96; region 338..367
  id AA056148
  misc_feature 88..189: est; blastn; identity 98; region 1..102
  id HSC1FF051
  misc_feature 314..401: est; blastn; identity 96; region 230..317
  id HSC1FF051
  misc_feature 187..271: est; blastn; identity 95; region 101..185
  id HSC1FF051
  misc_feature 269..317: est; blastn; identity 93; region 184..232
  id HSC1FF051
  misc_feature 397..426: est; blastn; identity 96; region 314..343
  id HSC1FF051
  misc_feature 87..200: est; blastn; identity 92; region 1..114
  id HSC16E081
  misc_feature 314..401: est; blastn; identity 96; region 231..318
  id HSC16E081
  misc_feature 199..275: est; blastn; identity 94; region 114..190
  id HSC16E081
  misc_feature 269..317: est; blastn; identity 91; region 185..233
  id HSC16E081
  misc_feature 397..426: est; blastn; identity 96; region 315..344
  id HSC16E081
  misc_feature 85..186: est; blastn; identity 99; region 24..125
  id AA157365
  misc_feature 183..263: est; blastn; identity 90; region 123..203
  id AA157365
  misc_feature 337..401: est; blastn; identity 95; region 278..342
  id AA157365
  misc_feature 273..326: est; blastn; identity 90; region 213..266
  id AA157365
  est
  misc_feature 15,225..226: n=a, g, c or t
  unsure -65: position -65 of amino acid sequence
  unsure -49: Xaa = Ala,Cys,Asp,Phe,Gly,His,Ile,Leu,Asn,Pro,Arg,Ser,Thr,Val,Tyr; position -49 of amino acid sequence; Xaa = Ala,Pro
aatgcgcgctcgcgntcccgccctctagctgcgctcggctgagtcagtcagtctgtcggagtctgtcctcggagcaggcggagtaaagggacttgagcgagccagttgccggattattctatttcccctccctctctcccgccccgtatctcttttcacccttctcccaccctcgctcgcgtascatggcggagcgtcggcggccactcagtcccattccatctnntcgtcgtccttcggagccgagccgtccgcgcccggcggcggcgggasccaggagcctgccccgccctggggacgaagagctgcagctcccctgtgcggtgcacgatctgattttctggagagatgtgaagaagactgggtttgtctttggcaccacgctgatcatgctgctttcctggcagctttcagtgtcatcagtg

SEQ ID NO: 179 - DNA, 403 bp, Homo Sapiens
  Brain
  sig_peptide 5..331: Von Heijne matrix
  score 6.00
  misc_feature 105..351: seq LQLLLGMTASAVA/AL; blastn; identity 98; region 49..295
  id R47336
  misc_feature 58..107: est; blastn; identity 98; region 1..50
  id R47336
  misc_feature 352..381: est; blastn; identity 100; region 295..324; id R47336; est
aaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagatggggtcgaggatttggtcttttgggttccatttttggaaaggatggtgtattaaaccagccaaacagtgtctttggacttatattttatatactacagttattacttggcatgacagcaagcgctgtggcggctttgatcctcatgacgtcctccatcatgtcggtcgtggggtcctgtacctggcctacattctgtactacg

SEQ ID NO: 180 - DNA, 367 bp, Homo Sapiens
  Brain
  sig_peptide 50..151: Von Heijne matrix
  score 5.90
  misc_feature 112..260: seq LGAAALALLLANT/DV; blastn; identity 92; region 121..269
  id W31320
  misc_feature 47..118: est; blastn; identity 100; region 57..128
  id W31320
  misc_feature 273..333: est; blastn; identity 98; region 282..342
  id W31320
  misc_feature 107..260: est; blastn; identity 98; region 2..155
  id T27259
  misc_feature 273..369: est; blastn; identity 100; region 168..264
  id T27259
  misc_feature 145..260: est; blastn; identity 90; region 108..223
  id AA157646
  misc_feature 59..118: est; blastn; identity 90; region 25..84
  id AA157646
  misc_feature 273..307: est; blastn; identity 94; region 245..279
  id SSC8A04
  unsure 8: est; position 8 of amino acid sequence; Xaa = His,Leu,Gln
aatatacttctttgtcaagagaagcagaggtgtggacgctgtgtatgaaatgtctttcctccaggacccaagtttcttcaccatggggatgtggtccattggtgcaggagccctgggggctgctgccttggcattgctgcttgccaacacagacgtgtttctgtccaagccccwkaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggc

SEQ ID NO: 181 - DNA, 257 bp, Homo Sapiens
  Brain
  sig_peptide 90..200: Von Heijne matrix
  score 4.90
  misc_feature 138..257: seq MLIMLGIFFNVHS/AV; blastn; identity 98; region 83..202
  id W31692
  misc_feature 55..131: est; blastn; identity 100; region 1..77
  id W31692
  misc_feature 136..257: est; blastn; identity 98; region 78..199
  id H50194
  misc_feature 57..131: est; blastn; identity 100; region 1..75
  id H50194
  misc_feature 57..257: est; blastn; identity 97; region 1..201
  id H46855
  misc_feature 138..257: est; blastn; identity 98; region 81..200
  id H49687
  misc_feature 57..132: est; blastn; identity 100; region 1..76
  id H49687
  misc_feature 138..257: est; blastn; identity 98; region 80..199
  id T54405
  misc_feature 58..124: est; blastn; identity 100; region 2..68; id T54405; est
atctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttgataatgctcggaatatttttcaatgtccattccgctgtgttgattgaggacgttcccttcacggagaaagattttgagaacggcccccgg

SEQ ID NO: 182 - DNA, 400 bp, Homo Sapiens
  Brain
  sig_peptide 305..364: Von Heijne matrix
  score 4.90
  misc_feature 365..401: seq XSLFLHAVSSSFT/QL; blastn; identity 100; region 1..37
  id R50224
  unsure -13: est; position -13 of amino acid sequence; Xaa = Leu,Arg
atgaccacgggtttaaccttcttatcccagagacacccaattctagagctttatggagccgtacttccccctgaatcctagctctaggacatagatcatgactctcagcccttttacccaggatggagctggggcctgtatagccatattattgttctaagtaagttctagccccaccctcccgccttcttgagtgatacctattacggatgagttctggaaaagacccagctatgattcataaaaacacttctggatgaatcaagaaccatttcttgtttktcctagataattctctaaaaatatgattcttccatatagaatgckaagcttatttttacatgcagtttctagctccttcacccagctgaggtcgtgccagggagacagagtctggaga

SEQ ID NO: 183 - DNA, 256 bp, Homo Sapiens
  Brain
  sig_peptide 23..211: Von Heijne matrix
  score 4.80
  misc_feature 86..186: seq LYTVRALAGRAWA/AV; blastn; identity 93; region 5..105
  id AA096741
  unsure 7: est; position 7 of amino acid sequence; Xaa = Ala,Pro
agaagtgcgtsycggcgggatcatggcgactttggtcgaactgccggactcggtcctgctcgagatcttctcttacctcccggtacgggaccggatccgcatctccagggtctgtcaccgctggaagaggctggtggacgaccggtggctgtggcgacatgtcgacctgacgctctacacggtacgcgcactggccgggcgggcctgggccgcggtcgcggtgcccggascccgaagaccacctctcccaccctgg

SEQ ID NO: 184 - DNA, 352 bp, Homo Sapiens
  Brain
  sig_peptide 77..199: Von Heijne matrix
  score 4.70
  misc_feature 183..348: seq LFSCFCFLSHKFG/KK; blastn; identity 98; region 78..243
  id W52941
  misc_feature 286..348: est; blastn; identity 96; region 1..63
  id H55390
  unsure 44: est; position 44 of amino acid sequence; Xaa = Pro,Thr
aaaaaatatctcccggcgtgcgctgcttgtgttatgttcgggttttaagtcgtgtcagcgtttacattttcttaatatgaaaaatgcctgcattgttctgccgccaactccccctccctccctgcaaccctcggcctctctgctggcgcctaatcgttttttattctcttgcttctgctttcttagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgmctcccaccaagacaccaccaggg

SEQ ID NO: 185 - DNA, 274 bp, Homo Sapiens
  Brain
  sig_peptide 110..193: Von Heijne matrix
  score 4.60
  misc_feature 99..260: seq PLQWSLLVAVVAG/SV; blastn; identity 96; region 126..287
  id T53519
  misc_feature 40..108: est; blastn; identity 91; region 1..69
  id T53519
  misc_feature 113..269: est; blastn; identity 96; region 131..287
  id W87344
  misc_feature 147..269: est; blastn; identity 96; region 138..260
  id N56542
  misc_feature 113..149: est; blastn; identity 91; region 105..141
  id N56542
  misc_feature 75..105: est; blastn; identity 96; region 1..31
  id N56542
  misc_feature 113..218: est; blastn; identity 96; region 117..222
  id AA053475
  misc_feature 218..269: est; blastn; identity 94; region 223..274
  id AA053475
  misc_feature 113..269: est; blastn; identity 95; region 90..246
  id W05444
  unsure 11: est; position 11 of amino acid sequence; Xaa = Glu,Lys
acttccgcctgcgcctgcgcagcvcagctccshgagccctgccaaccatggtgaacttgggtctgtcccgggtggacgacgccgtggctgccaagcacccggcaccggcatggcctttggcttgcagatgttcattcagaggaagtttccataccctttgcagtggagcctcctagtggccgtggttgcaggctctgtggtcagctacggggtgacgagagtrragtcggagaaatgcaacaacctctggctcttcctggagaccggacttggg

SEQ ID NO: 186 - DNA, 316 bp, Homo Sapiens
  Brain
  sig_peptide 110..268: Von Heijne matrix
  score 4.50
  misc_feature 45..315: seq LLWTPLLSPGSLR/VI; blastn; identity 98; region 1..271; id HSC1ZD051; est
atatgagactctggcctccctgcagatcttctaagaaccacactaatgcaagcgtgacagagaaacctctttcgaatgacctactacaactctggcattggttagttccatgtattgtaagattctggtgctaatgctccatacagaattgatcaggactgattactcttctgtggaccaattgctattgaactacccagctgaagagggtttggggagagaacgttcattattatggactccacttttgtcscctggtagtttaagggtgatactagaatccagagaagttcctgtctccttgtggccccaaacg

SEQ ID NO: 187 - DNA, 423 bp, Homo Sapiens
  Brain
  sig_peptide 166..243: Von Heijne matrix
  score 4.50
  misc_feature 50..246: seq ENSLIILLQGLQG/RV; blastn; identity 96; region 1..197
  id AA043070
  misc_feature 241..373: est; blastn; identity 97; region 191..323
  id AA043070
  misc_feature 371..408: est; blastn; identity 100; region 322..359
  id AA043070
  misc_feature 186..357: est; blastn; identity 95; region 29..200
  id W81202
  misc_feature 345..423: est; blastn; identity 100; region 189..267
  id W81202
  misc_feature 64..177: est; blastn; identity 100; region 85..198
  id W24858
  misc_feature 178..227: est; blastn; identity 90; region 198..247
  id W24858
  unsure 19: est; position 19 of amino acid sequence; Xaa = Lys,Asn
aactctgcgcccggaggacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagccattcagtgaaggagcggaccatctctgagaacagcctgatcatcctactgcagggcctccagggccgggtaaccactgtggacctgcgggatgagagcgtggcccacggacgcatagacaabgtcgatgctttcatgaacatccgcctggccaaagtcacctacacggaccgttgggggcatcaggtcaagctggatgacctctttgtgacaggccgcaatgtccgctacgtccacatcccagat

SEQ ID NO: 188 - DNA, 343 bp, Homo Sapiens
  Brain
  sig_peptide 71..139: Von Heijne matrix
  score 4.40
  misc_feature 165..302: seq QFILLGTTSVVTA/AL; blastn; identity 93; region 33..170
  id T50032
  misc_feature 291..339: est; blastn; identity 97; region 160..208
  id T50032
  misc_feature 132..172: est; blastn; identity 97; region 1..41
  id T50032
  est
  misc_feature 334: n=a, g, c or t
  unsure 65: position 65 of amino acid sequence; Xaa = Lys,Asn
aaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtgccttatgctgttatagaaggagctgtgcggtctgttaaagaaacgcttaacagccagtttgtggaaaactgcaanggggtccgg

SEQ ID NO: 189 - DNA, 481 bp, Homo Sapiens
  Brain
  sig_peptide 56..472: Von Heijne matrix
  score 4.30
  misc_feature 133..355: seq GILVPHSLRQAQA/SF; blastn; identity 96; region 3..225
  id H10707
  misc_feature 353..482: est; blastn; identity 97; region 224..353
  id H10707
  misc_feature 154..354: est; blastn; identity 93; region 98..298
  id H30624
  misc_feature 368..403: est; blastn; identity 94; region 314..349
  id H30624
  misc_feature 200..354: est; blastn; identity 94; region 150..304
  id HSC1VG011
  misc_feature 111..198: est; blastn; identity 92; region 62..149
  id HSC1VG011
  misc_feature 49..85: est; blastn; identity 97; region 1..37
  id HSC1VG011
  misc_feature 202..344: est; blastn; identity 97; region 113..255
  id R34406
  misc_feature 111..198: est; blastn; identity 94; region 23..110
  id R34406
  misc_feature 353..482: est; blastn; identity 99; region 115..244
  id HSC23C111
  misc_feature 240..355: est; blastn; identity 94; region 1..116
  id HSC23C111
  unsure -131,-120: est
  position -131 and -120 of amino acid sequence
  unsure -118: Xaa = Asp,Glu
  position -118 of amino acid sequence
  unsure -66: Xaa = Glu,Gly
  position -66 of amino acid sequence
  unsure -65: Xaa = Asp,Gly,Val
  position -65 of amino acid sequence
  unsure -62: Xaa = Pro,Ser; position -62 of amino acid sequence; Xaa = Ala,Cys,Gly,Ser,Thr
aaaaactgcggagggtgacaaggaagaaggtggctccagatctggaggtgtgtccatggcggcgcttgacctgcgagcggastggattcgctggtcctgcagctgcttgggggamctggraggagctggaggggaaacgaacggtgttgaacgcccgggtggaggagggctggctctcgctcgccaaggctcgctacgcgatgggcgccaagtcggtagggcccctgcagtatgcttcccacatggagccccaggtctgcctccacgccagcgagdcycaggagggdstccagaagttcaaggtggtgagagctggtgtccacgccccagaggaggtggggcctcgcgaacaggtctgcggaggcgcaagggccccactaagaccccagaaccggagtcctctgaggcccctcaggaccccctgaactggtttggaatcctagttcctcacagtctacgtcaggctcaagcaagcttccgg

SEQ ID NO: 190 - DNA, 302 bp, Homo Sapiens
  Brain
  sig_peptide 216..278: Von Heijne matrix
  score 4.10
  misc_feature 176..275: seq WWISLLPSLLSIC/KV; blastn; identity 100; region 2..101; id R68368; est
aagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatctgcaaggtcttgatgcccaagttaaag

SEQ ID NO: 191 - DNA, 414 bp, Homo Sapiens
  Brain
  sig_peptide 34..180: Von Heijne matrix
  score 3.80
  misc_feature 40..271: seq PAFHLPLPGPTLA/FL; blastn; identity 97; region 1..232
  id R00384
  misc_feature 294..328: est; blastn; identity 94; region 257..291
  id R00384
  misc_feature 86..130: est; blastn; identity 93; region 140..184
  id MMTEST284
  unsure 55: est
  position 55 of amino acid sequence
  unsure 56: Xaa = Glu,Gly; position 56 of amino acid sequence; Xaa =  * ,Lys,Pro,Gln,Ser,Thr
aattccccagcaagctcagcgtgtamstgcgctatggagccgaaagtcgcagagctgaagcagaagatcgaggacacgctatgtccttttggcttcgaggtttaccccttccaggtggcatggtacaatgaactcttgcctccagccttccacctaccgctgccaggacctaccctggccttcctggtactcagcacgcctgccatgtttgaccgggccctcaagcccttcttgcagagctgccacctccgaatgctgactgacccagtggaccagtgtgtggcctaccatctgggccgtgttagagagagcctcccagagctgcagatagaaatcattgctgrahmacgaggtgcaccccaaccgacgccccaagatcctggcccagacagcagccatgtagctggggctgct

SEQ ID NO: 192 - DNA, 400 bp, Homo Sapiens
  Brain
  sig_peptide 107..145: Von Heijne matrix
  score 3.70
  misc_feature 324..389: seq MLVLRSGLTKALA/SR; blastn; identity 95; region 301..366
  id T08430
  misc_feature 64..400: est; blastn; identity 90; region 1..337
  id C17891
  misc_feature 301..400: est; blastn; identity 95; region 1..100; id C04989; est
agagttcgccagtggtccaggagccgcttttttccactcgggaagacttcagagaagtctcacaaaggactcggctggctgcttttctcagtgccgaagccgcgccatgctcgttctcagaagcggcctgaccaaggcgcttgcctcacggacgctcgcgcctcaggtgtgttcatcttttgctacgggccctagacaatacgatggaacgttctatgaatttcgtacttattaccttaaaccttcaaatatgaatgcgttcatggaaaatcttaagaaaaacattcatcttcggacctcttactctgaattggttggattctggagtgtagaatttggaggcagaacgaataaagtgtttcatatttggaagtatgataattttgctcatcgagctgaa

SEQ ID NO: 193 - DNA, 186 bp, Homo Sapiens
  Brain
  sig_peptide 106..174: Von Heijne matrix
  score 10.50
  misc_feature 112..184: seq LLFVLLLFSLLPA/CL; blastn; identity 98; region 1..73
  id HSC09D101
  misc_feature 112..184: est; blastn; identity 98; region 1..73
  id HSC2UE011
  misc_feature 112..186: est; blastn; identity 90; region 1..75
  id HSC09C101
  misc_feature 140..184: est; blastn; identity 95; region 17..61; id T35421; est
atatttaaacgacccttcaaaggcccttaggtttccttgcctctgctcacagaactagtccagccaggtgtcgctgctgcctcagagctgtgtggggtcgcrtgtatgtcggggggccatcttgccgatttaacgctgctttttgtgttgttgttgttttccctcctccctgcctgcctaccccgg

SEQ ID NO: 194 - DNA, 335 bp, Homo Sapiens
  Brain
  sig_peptide 174..326: Von Heijne matrix
  score 10.10
  misc_feature complement(86..336): seq LLGALTLLGLVTS/FY; blastn; identity 99; region 79..329
  id AA148596
  misc_feature complement(30..91): est; blastn; identity 100; region 325..386
  id AA148596
  misc_feature complement(2..39): est; blastn; identity 92; region 378..415
  id AA148596
  misc_feature complement(2..336): est; blastn; identity 99; region 67..401
  id AA074631
  misc_feature complement(83..336): est; blastn; identity 99; region 64..317
  id AA078818
  misc_feature complement(8..48): est; blastn; identity 97; region 355..395
  id AA078818
  misc_feature complement(30..336): est; blastn; identity 99; region 64..370
  id N21054
  misc_feature complement(68..236): est; blastn; identity 98; region 172..340
  id AA157994
  misc_feature complement(225..336): est; blastn; identity 94; region 73..184
  id AA157994
  misc_feature complement(28..68): est; blastn; identity 100; region 341..381; id AA157994; est
aattctcaacgagctgcgggctcggcatgcccaggggggtacatggtatggagtagacatcaacaacgaggacattgctgacaactttgaagctttcgtgtgggagccagctatggtgcggatcaatgcgctgacagcagcctctgaggctgcgtgcctgatcgtgtctgtagatgaaaccatcaagaacccccgctcgactgtggatgctcccacagcagcaggccggggccgtggtcgtggccgcccccactgagaggcaccccacccatcacatggctggctggctgctgggtgcacttaccctccttggcttggttacttcattttacaag

SEQ ID NO: 195 - DNA, 419 bp, Homo Sapiens
  Brain
  sig_peptide 27..218: Von Heijne matrix
  score 9.50
  misc_feature 23..200: seq LSLLAALAHLAAA/EK; blastn; identity 100; region 9..186
  id W44639
  misc_feature 216..356: est; blastn; identity 99; region 200..340
  id W44639
  misc_feature 363..412: est; blastn; identity 100; region 347..396
  id W44639
  est
  misc_feature 361..362: n=a, g, c or t
  unsure 47: position 47 of amino acid sequence
  unsure 48: Xaa =  * ,Cys,Asp,Glu,Phe,Gly,Ile,Lys,Leu,Met,Asn,Arg,Ser,Val,Trp,Tyr; position 48 of amino acid sequence; Xaa =  * ,Cys,Phe,Leu,Ser,Trp,Tyr
agtgggtcgakctggggcgcagtcgcatgggggagtctatcccgctggccgccccggtcccggtggaacaggcggtgctggagacgttcttctctcacctgggtatcttctcttacgacaaggctaaggacaatgtggagaaggaacgagaggccaacaagagcgcggggggcagctggctgtcgctgctggcggccttggcgcacctggccgcggccgagaaggtctatcacagcctcacctacctggggcagaaactagggggccagtctttcttcagcaggaaggattccatccgcaccatctatacttcattgcataatgagctgaagaaggtggtgactggccgtggtgccddktnntgggactgctcctcacgtggaagaactcctttcccacctgtcagagcagcatacggg

SEQ ID NO: 196 - DNA, 342 bp, Homo Sapiens
  Brain
  sig_peptide 85..198: Von Heijne matrix
  score 9.30
  misc_feature 33..269: seq QLLYLSLLSGLHG/QE; blastn; identity 99; region 10..246
  id AA058587
  misc_feature 272..307: est; blastn; identity 100; region 248..283
  id AA058587
  misc_feature 133..259: est; blastn; identity 100; region 87..213
  id R12128
  misc_feature 47..134: est; blastn; identity 98; region 2..89
  id R12128
  misc_feature 303..337: est; blastn; identity 97; region 257..291
  id R12128
  misc_feature 49..259: est; blastn; identity 98; region 2..212
  id H19999
  misc_feature 272..304: est; blastn; identity 96; region 225..257
  id H19999
  misc_feature 303..337: est; blastn; identity 91; region 257..291
  id H19999
  misc_feature 42..252: est; blastn; identity 99; region 1..211
  id R20025
  misc_feature 87..259: est; blastn; identity 99; region 1..173
  id H83838
  misc_feature 272..337: est; blastn; identity 98; region 186..251; id H83838; est
aggctgcggtaaatccgggcttgcggccgctggcgtagtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggctcagctccgcaccgcgctggcctctggaggcgtcctggacgctagcggcgattaccgcgtctacaggggccatggg

SEQ ID NO: 197 - DNA, 461 bp, Homo Sapiens
  Brain
  sig_peptide 384..455: Von Heijne matrix
  score 9.10
  misc_feature complement(149..337): seq LFAFHLLLSFILG/SR; blastn; identity 97; region 182..370
  id AA142966
  misc_feature complement(340..459): est; blastn; identity 97; region 61..180
  id AA142966
  misc_feature complement(142..337): est; blastn; identity 98; region 183..378
  id AA019334
  misc_feature complement(340..459): est; blastn; identity 97; region 62..181
  id AA019334
  misc_feature complement(345..459): est; blastn; identity 95; region 48..162
  id N66447
  misc_feature complement(255..337): est; blastn; identity 97; region 170..252
  id N66447
  misc_feature complement(111..181): est; blastn; identity 95; region 330..400
  id N66447
  misc_feature complement(179..228): est; blastn; identity 98; region 282..331
  id N66447
  misc_feature complement(172..337): est; blastn; identity 97; region 113..278
  id R85770
  misc_feature complement(340..450): est; blastn; identity 98; region 1..111
  id R85770
  misc_feature 188..337: est; blastn; identity 99; region 1..150
  id R78830
  misc_feature 339..459: est; blastn; identity 96; region 151..271
  id R78830
  est
  misc_feature 338: n=a, g, c or t
aacactgttgtataaactaatctttgcttgttttctactctgtgatctttccatatcatatttcattaatgatcagttagtgtcaaggagtcaaaacagattaaaattaatttcatgtgtatatggtggaaatttgtggctagtgtgatttttgtttgtytccttttaagtactgttgatcagttgtgacacttactggttaaacttacgttgctaaagatttctctataataagccacacattatatttagactatattaagggaccttggttttcttctagatagcagctgtcccaaagaaaatatttcttctttgtctgtkaagatttagctatnkatctgccagttgttcagmggttttggttccaaactcaaccagcaatgttgagagctgaacttaagatagctgttgtactttttgctttccatctgttactgtccttcattctcggctcccgg

SEQ ID NO: 198 - DNA, 229 bp, Homo Sapiens
  Brain
  sig_peptide 2..166: Von Heijne matrix
  score 9.00
  misc_feature complement(1..130): seq LLILLLRTFLCSA/MI; blastn; identity 98; region 8..137; id H63707; est
aatgaatcatcaacagacattaattgggcgcctgctctgtgatctccatgggctcagcttgtccccgccagtwgccaacaacgtccaagctctcttcagaatgcttactcctgaagcttattcctgtcttctaattcttttgttgaggacttttctgtgtagtgcaatgatagcaaatacacttcatctcaagtaccatctccaattgattgataatgcctgccctgag

SEQ ID NO: 199 - DNA, 278 bp, Homo Sapiens
  Brain
  sig_peptide 27..146: Von Heijne matrix
  score 8.60
  misc_feature 145..279: seq LFCVLGIVLLVTG/IV; blastn; identity 100; region 1..135
  id H06014
  misc_feature 180..279: est; blastn; identity 100; region 11..110
  id R15960
  misc_feature 204..279: est; blastn; identity 96; region 1..76; id W67034; est
accaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcac

SEQ ID NO: 200 - DNA, 333 bp, Homo Sapiens
  Brain
  sig_peptide 67..261: Von Heijne matrix
  score 8.40
  misc_feature 55..268: seq LLWFIHLVFVVLX/LF; blastn; identity 95; region 32..245
  id T60555
  misc_feature 22..51: est; blastn; identity 90; region 1..30
  id T60555
  unsure -1: est
  position -1 of amino acid sequence
  unsure 9: Xaa = Ala,Gly
  position 9 of amino acid sequence
  unsure 16: Xaa =  * ,Leu; position 16 of amino acid sequence; Xaa = Lys,Arg
aagaggcttacgagswccaggtggagaggccgggctggccaaggcttcggcctccggcgtcgggaaatggcggcggggggcaggatggaggacggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgtwttagsattgtttaacaggtgtgctttgttctwatcctatcccaaatgggacargtgcccaggaaattacacaaaccca

SEQ ID NO: 201 - DNA, 337 bp, Homo Sapiens
  Brain
  sig_peptide 161..208: Von Heijne matrix
  score 7.50
  misc_feature 125..306: seq GCMLLFVFGFVGG/AV; blastn; identity 95; region 95..276
  id H31193
  misc_feature 69..130: est; blastn; identity 93; region 40..101
  id H31193
  misc_feature 29..68: est; blastn; identity 97; region 1..40; id H31193; est
aatcgcttgggagctgctgcaggatggagtggaaagctgctgctgatggcattgtttttgtggcagcaagctgaatgacagatcctcactacaaagatacccctttggcccccgtgtaggcctccttggttcgggtgtttcaccatgccagcacagcgccatgagtcctggatgcatgctgctgtttgtgtttggctttgttggcggggcggtggtcattaattctgctatcttagtatctctctctgttttgctgcttgtgcacttttctatttctaccggtgtgccagctctgacgcagaacctaccaaggatactcagaaaagaacgccccggg

SEQ ID NO: 202 - DNA, 309 bp, Homo Sapiens
  Brain
  sig_peptide 109..153: Von Heijne matrix
  score 7.50
  misc_feature 105..252: seq LLLGIALLAYVAS/VW; blastn; identity 94; region 136..283
  id HSU46355
  misc_feature 53..83: est; blastn; identity 90; region 82..112
  id HSU46355
  misc_feature 227..276: est; blastn; identity 94; region 206..255
  id AA011705
  unsure 38: est; position 38 of amino acid sequence; Xaa = Glu,Gly
aatbgtgcagcaggcgggcccccgcgcggcagggscctggacccgcgcggctccctgggatggtgagcaaggcgctgctgcsctcgtgtctgccgtcaaccgcagasgatgaagctgctgctgggcatcgccttgctggcctacgtcgcctctgtttggggcaacttcgttaatatgaggtctatccaggaaaatggtgaactaaaaattgaaagcaagattgaagagatggttgaaccactaagagagaaaatcagagatttagraaaaagctttacccagaaatacccaccagtaaagtttttatca

SEQ ID NO: 203 - DNA, 491 bp, Homo Sapiens
  Brain
  sig_peptide 39..107: Von Heijne matrix
  score 7.50
  misc_feature 132..251: seq LVLLLTLPLHLMA/LL; blastn; identity 99; region 170..289
  id T60981
  misc_feature 19..126: est; blastn; identity 99; region 57..164
  id T60981
  unsure 109: est; position 109 of amino acid sequence; Xaa = Lys,Gln
aagtgccccagcggaagacagctcagagctggtctgccatggacatcctggtcccactcctgcagctgctggtgctgcttcttaccctgcccctgcacctcatggctctgctgggctgctggcagcccctgtgcaaaagctacttcccctacctgatggccgtgctgactcccaagagcaaccgcaagatggagagcaagaaacgggagctcttcagccagataaaggggcttacaggagcctccgggaaagtggccctactggagctgggctgcggaaccggagccaactttcagttctacccaccgggctgcagggtcacctgcctagacccaaatccccactttgagaagttcctgacaaagagcatggctgagaacaggcacctccaatatgagcggtttgtggtggctcctggagaggacatgagamagctggctgatggctccatggatgtkgtggtctgcactctggtgctgtgctctgtgcag

SEQ ID NO: 204 - DNA, 331 bp, Homo Sapiens
  Brain
  sig_peptide 23..127: Von Heijne matrix
  score 7.40
  misc_feature 25..303: seq SLLLSLELASGSG/QG; blastn; identity 98; region 1..279
  id HSC0ZA041
  misc_feature 131..286: est; blastn; identity 97; region 106..261
  id R12615
  misc_feature 71..133: est; blastn; identity 100; region 47..109
  id R12615
  misc_feature 88..303: est; blastn; identity 99; region 1..216
  id HUM401H04B
  misc_feature 137..303: est; blastn; identity 95; region 92..258
  id T78771
  unsure -21: est; position -21 of amino acid sequence; Xaa = Ser,Thr
aaagggcggasttcaggtctccatggaggcggcttctcctagcaactcgacgggcgttgagcggascgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctataggtccagatcaaggaagagacccgcactg

SEQ ID NO: 205 - DNA, 317 bp, Homo Sapiens
  Brain
  sig_peptide 108..236: Von Heijne matrix
  score 7.40
  misc_feature 46..119: seq VLVKLLSSSASTS/RP; blastn; identity 93; region 12..85
  id N80882
  misc_feature 88..119: est; blastn; identity 100; region 1..32
  id H92328
  est
  misc_feature 8: n=a, g, c or t
agtttcgnstcgcggatccggtaggtccaggtgcagcggccgcagtkctgcgtccgtgcgccgcgggctggggcggtctcaggtgtgccgaagctctggtcagtgccatgatccggcaggagcgctccacatcctaccaggaggctgtgcgtccagcgcttccttcaagcaagccctgcctcctcacttctccagctgtattagtgaaactgctctcctcctccgcctccacttctcggcccccagaccttggtcatctttggcaaccgtcctcttctgtgcccctccatcggccgccacacactgcaccaccagcg

SEQ ID NO: 206 - DNA, 363 bp, Homo Sapiens
  Brain
  sig_peptide 25..147: Von Heijne matrix
  score 7.40
  misc_feature 26..365: seq ILPLLFGCLGVFG/LF; blastn; identity 96; region 1..340
  id N40260
  misc_feature 17..308: est; blastn; identity 93; region 6..297
  id W07706
  misc_feature 311..349: est; blastn; identity 100; region 301..339
  id W07706
  misc_feature 79..365: est; blastn; identity 95; region 22..308
  id W37568
  misc_feature 140..326: est; blastn; identity 93; region 74..260
  id W00732
  misc_feature 328..365: est; blastn; identity 100; region 263..300
  id W00732
  misc_feature 79..362: est; blastn; identity 95; region 14..297
  id AA135041
  unsure 39: est
  position 39 of amino acid sequence
  unsure 48: Xaa = Ala,Glu,Lys,Thr; position 48 of amino acid sequence; Xaa = Pro,Thr
acacgtcacttccgaggcgggaggatgaagttgattgactatggtctctccggctaccaggaagagtctgccgaagtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctrmgggtgctaaactggtgctctgtgarmcggaatggtggggcctagaagagctcatcagagaactcaccgcttctcatgccaccaaggtgcagacacacaag

SEQ ID NO: 207 - DNA, 235 bp, Homo Sapiens
  Brain
  sig_peptide 104..160: Von Heijne matrix
  score 7.40
  misc_feature 60..181: seq PMLLRALAQAARA/GP; blastn; identity 97; region 1..122
  id AA057454
  misc_feature 182..233: est; blastn; identity 96; region 122..173
  id AA057454
  misc_feature 71..233: est; blastn; identity 99; region 1..163
  id C18312
  misc_feature 182..233: est; blastn; identity 100; region 144..195
  id W69247
  misc_feature 98..144: est; blastn; identity 100; region 62..108
  id W69247
  misc_feature 34..78: est; blastn; identity 97; region 1..45
  id W69247
  misc_feature 146..233: est; blastn; identity 100; region 69..156
  id H75891
  misc_feature 76..144: est; blastn; identity 95; region 1..69
  id H75891
  misc_feature 80..233: est; blastn; identity 98; region 1..154; id HUML11265; est
ataagggggaacccgctggcccaatggcagcgtcctacagtgtagcctccgcctcccgattgactggcctgcttggcaakgcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcaa

SEQ ID NO: 208 - DNA, 385 bp, Homo Sapiens
  Brain
  sig_peptide 134..334: Von Heijne matrix
  score 7.00
  misc_feature 70..351: seq IWTLLSSVIRCLC/AI; blastn; identity 97; region 34..315
  id T19063
  misc_feature 36..68: est; blastn; identity 96; region 1..33
  id T19063
  misc_feature 61..353: est; blastn; identity 98; region 1..293
  id T32338
  misc_feature 93..360: est; blastn; identity 99; region 1..268
  id T30463
  misc_feature complement(107..265): est; blastn; identity 91; region 330..488
  id W27204
  misc_feature complement(257..385): est; blastn; identity 99; region 209..337
  id W27204
  misc_feature 70..324: est; blastn; identity 99; region 27..281; id T32187; est
agacaaatggctcaggtggactccgggctggagctgtcctgggggagcttgtttgcggcasggctgctgctgccactgctgtgctggsggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttc

SEQ ID NO: 209 - DNA, 285 bp, Homo Sapiens
  Brain
  sig_peptide 199..240: Von Heijne matrix
  score 6.80
  misc_feature complement(2..55): seq IFLTLSLDSRVSA/IR; blastn; identity 92; region 34..87
  id T86932
  misc_feature complement(45..86): est; blastn; identity 100; region 2..43
  id T86932
  unsure 13: est; position 13 of amino acid sequence; Xaa = Ala,Asp,Asn,Ser,Thr,Tyr
aaataaaaatatcttaaaactgcattgtacagctccctccctgcgttttattaaatgatgtatattaaacaaagatcaatattttcttaatgactcagggtctttattgttaatgccaattgtttttgtatctgtgctataatcccttagagtcagtaaagtatgtaggggactgtttcttcctttgtgtctgggtttatgatttttctcactctttctttggactccagggtgtcagccatcaggtctcctaattttgtgtaccggtctccaacadmccatggg

SEQ ID NO: 210 - DNA, 378 bp, Homo Sapiens
  Brain
  sig_peptide 76..162: Von Heijne matrix
  score 6.80
  misc_feature 65..270: seq LIFLCGAALLXVG/IW; blastn; identity 97; region 109..314
  id AA100852
  misc_feature 269..378: est; blastn; identity 94; region 314..423
  id AA100852
  misc_feature 65..270: est; blastn; identity 97; region 109..314
  id AA161042
  misc_feature 277..361: est; blastn; identity 94; region 323..407
  id AA161042
  misc_feature 65..274: est; blastn; identity 97; region 104..313
  id H64488
  misc_feature 68..256: est; blastn; identity 97; region 147..335
  id AA146605
  misc_feature 256..317: est; blastn; identity 96; region 336..397
  id AA146605
  misc_feature 80..305: est; blastn; identity 98; region 129..354
  id AA088770
  unsure -3: est
  position -3 of amino acid sequence
  unsure 48: Xaa = Ala,Thr
  position 48 of amino acid sequence
  unsure 54: Xaa = Gly,Arg
  position 54 of amino acid sequence
  unsure 62: Xaa =  * ,Lys; position 62 of amino acid sequence; Xaa = Cys,Phe
aatactacacactcatataggggagggaggcttctgggtcccagggccgcaggggcakkgaagtctggagccwycatgcagtgcttcagcttcattaagaccatgatgatcctcttcaatttgctcatctttctgtgtggtgcagccctgttrrcagtgggcatctgggtgtcaatcgatggggcatcctttctgaagatcttcgggccactgtcgtccagtgccatgcagtttgtcaacgtgggctacttcctcatcgcagccggcgttgtggtctttgctctyggtttcctgggctgctatsgtgctaagactgagagcwagtgtgccctcgtgacgttcttctkcatcctcctsctcatcttcattgctgacgtt

SEQ ID NO: 211 - DNA, 327 bp, Homo Sapiens
  Brain
  sig_peptide 37..141: Von Heijne matrix
  score 6.40
  misc_feature 234..288: seq SACLLLCPTWTNP/QL; blastn; identity 96; region 203..257
  id R25833
  misc_feature 285..317: est; blastn; identity 100; region 255..287
  id R25833
  est
  misc_feature 230,322: n=a, g, c or t
  unsure -25: position -25 of amino acid sequence
  unsure 30: Xaa = Arg,Thr
  position 30 of amino acid sequence
  unsure 31: Xaa = Ile,Asn,Ser,Thr
  position 31 of amino acid sequence
  unsure 61: Xaa = Cys,Phe,Gly,Ile,Leu,Met,Arg,Ser,Val,Trp; position 61 of amino acid sequence; Xaa = Gly,Arg,Trp
aaaaaaggcggggtctcggccggcgctgacgcagccatggcggaggcggctttggaagccgtgcggasgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccancdkktggtccctcccctatttcagagccacagtgggctccacagaggtgagtgtggccgtgaccccagatggttacgcggatgccgtdagangggat

SEQ ID NO: 212 - DNA, 244 bp, Homo Sapiens
  Brain
  sig_peptide 143..199: Von Heijne matrix
  score 6.40
  misc_feature 82..241: seq SVFLLMVNGQVES/AQ; blastn; identity 99; region 51..210
  id C18780
  misc_feature 48..83: est; blastn; identity 94; region 18..53
  id C18780
  misc_feature 163..235: est; blastn; identity 97; region 121..193
  id T11911
  misc_feature 116..162: est; blastn; identity 95; region 73..119
  id T11911
  misc_feature 204..239: est; blastn; identity 94; region 226..261; id T69629; est
agcactcgcgtggccttcgcgaaggtgtcgctgccaagaaacgtgtcctgcgcgctacgccgtctgtttttagggcaacgccggcgtctcttagcaaccgcgcgcggcctaggtgggtccccccggcacccccagacctgccatggcgaccgcgagtcctagcgtctttctactcatggtcaacgggcaggtggagagcgcccagtttccagagtatgatgacctctactgcaagtactgccag

SEQ ID NO: 213 - DNA, 211 bp, Homo Sapiens
  Brain
  sig_peptide 104..187: Von Heijne matrix
  score 6.00
  misc_feature 95..208: seq IGLMFLMLGCALP/IY; blastn; identity 100; region 85..198
  id N43024
  misc_feature 28..95: est; blastn; identity 91; region 17..84
  id N43024
  misc_feature 107..199: est; blastn; identity 98; region 80..172
  id T62095
  misc_feature 61..106: est; blastn; identity 93; region 35..80
  id T62095
  misc_feature 26..60: est; blastn; identity 97; region 1..35
  id T62095
  misc_feature 61..208: est; blastn; identity 98; region 26..173
  id W42796
  misc_feature 110..208: est; blastn; identity 92; region 114..212
  id AA030227
  misc_feature 110..208: est; blastn; identity 92; region 51..149; id AA118270; est
tcttccgggtgttgtctggccgccgtagcgcrtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggccctgg

SEQ ID NO: 214 - DNA, 128 bp, Homo Sapiens
  Brain
  sig_peptide 12..62: Von Heijne matrix
  score 5.90
  misc_feature 3..124: seq ILLFGTLLMNAGA/VL; blastn; identity 99; region 8..129
  id AA146587
  misc_feature 2..124: est; blastn; identity 98; region 14..136
  id T85006
  misc_feature 11..124: est; blastn; identity 100; region 1..114
  id H08511
  misc_feature 14..124: est; blastn; identity 98; region 1..111
  id C00740
  misc_feature 13..124: est; blastn; identity 98; region 1..112; id N40664; est
aggccgtaacgatgatcggagacatcctgctgttcgggacgttgctgatgaatgccggggcggtgctgaactttaagctgaaaaagaaggacacgcagggctttggggaggagtccagggagccttgg

SEQ ID NO: 215 - DNA, 150 bp, Homo Sapiens
  Brain
  sig_peptide 67..114: Von Heijne matrix
  score 5.90
  misc_feature 12..143: seq MILTLSLFGSCIS/NF; blastn; identity 99; region 36..167
  id HUM137D01B
  misc_feature 12..142: est; blastn; identity 99; region 143..273
  id AA155928
  misc_feature 12..141: est; blastn; identity 99; region 115..244
  id W39572
  misc_feature complement(12..135): est; blastn; identity 95; region 1..124
  id M78698
  misc_feature complement(32..151): est; blastn; identity 98; region 346..465; id H99266; est
acacatccctctaaactactgttaggaacagcagtgttctcacagtgtrgggcagccgtccttctaatgaagacaatgatattgacactgtccctctttggcagttgcattagtaactttgaaaggtatatgactgagcgtagcatccag

SEQ ID NO: 216 - DNA, 397 bp, Homo Sapiens
  Brain
  sig_peptide 152..268: Von Heijne matrix
  score 5.90
  misc_feature complement(223..398): seq SVSVLSSLGIVLA/VV; blastn; identity 96; region 111..286
  id HSGT545
  misc_feature complement(69..219): est; blastn; identity 92; region 291..441
  id HSGT545
  misc_feature complement(2..43): est; blastn; identity 97; region 467..508
  id HSGT545
  misc_feature complement(223..311): est; blastn; identity 92; region 4..92
  id AA036134
  misc_feature complement(46..163): est; blastn; identity 91; region 133..250
  id AA038839
  misc_feature complement(223..295): est; blastn; identity 97; region 1..73
  id AA038839
  misc_feature 326..387: est; blastn; identity 91; region 2..63
  id W51392
  est
  misc_feature 220..222: n=a, g, c or t
  unsure -31: position -31 of amino acid sequence
  unsure -30: Xaa =  * ,Trp
  position -30 of amino acid sequence
  unsure -17: Xaa = Ala,Pro
  position -17 of amino acid sequence
  unsure -16: Xaa = Asp,Glu
  position -16 of amino acid sequence
  unsure 33: Xaa = Ala,Cys,Asp,Phe,Gly,His,Ile,Leu,Asn,Pro,Arg,Ser,Thr,Val,Tyr; position 33 of amino acid sequence; Xaa = Leu,Met
actttgagggtgtctctggccatgtggtgtttgatgccagcbgctctcggatggcatggacgcttatcgagcagcttcagggtggcagctacaagaagattggctactatgacagcaccaaggatgatctttcctggtccaaaacagataaatggattggagggtcccccccagctgrscagaccctggtcatcaagacattccgcttcctgtcacagannnctttatctccgtctcagttctctccagcctgggcattgtcctagctgttgtctgtctgtcctttaacatctacaactcacatgtccgttatatccagaactcacagcccaacctgaacaacctgactgctgtgggctgctcamtggctttagctgctgtcttcccctggggctcg

SEQ ID NO: 217 - DNA, 373 bp, Homo Sapiens
  Brain
  sig_peptide 35..82: Von Heijne matrix
  score 5.80
  misc_feature 41..337: seq AALPAWLSLQSRA/RT; blastn; identity 97; region 1..297
  id H56523
  misc_feature 38..337: est; blastn; identity 96; region 1..300
  id AA020823
  misc_feature 43..337: est; blastn; identity 96; region 7..301
  id H99096
  misc_feature 49..315: est; blastn; identity 98; region 11..277
  id AA083141
  misc_feature 52..337: est; blastn; identity 96; region 17..302
  id N21197
  unsure 18: est
  position 18 of amino acid sequence
  unsure 52: Xaa = Arg,Thr
  position 52 of amino acid sequence
  unsure 82: Xaa = Ile,Ser
  position 82 of amino acid sequence
  unsure 87: Xaa = Glu,Gln; position 87 of amino acid sequence; Xaa = Met,Arg
agcttgtcccctccggcttgccgtcctcgcagccatggcggccgccgcgctcccagcatggctgtctctgcagtcgagggcaaggactctgcgtgcattctccactgccgtctactcggccactccggtcccgasacctagcctgccggaaagaacacccggaaatgaaaggccaccaagaagaaaggcactacctcctaggacagagaaaatggctgttgaccaggactggcctaktgtttacccagttgcagcaccatttaaaccctctgcagtacctcttcctgttcgaatgggttatccagtaaaaaagggcgtsccatggsaaaggagggaatctakgacttttaaagattccaattttctgcatttg

SEQ ID NO: 218 - DNA, 333 bp, Homo Sapiens
  Brain
  sig_peptide 247..321: Von Heijne matrix
  score 5.80
  misc_feature 32..331: seq LWISACAMLLCHG/SL; blastn; identity 99; region 1..300
  id R13004
  misc_feature 114..274: est; blastn; identity 99; region 54..214
  id T80337
  misc_feature 272..331: est; blastn; identity 100; region 213..272
  id T80337
  misc_feature 66..106: est; blastn; identity 100; region 6..46
  id T80337
  misc_feature 101..278: est; blastn; identity 94; region 70..247
  id T08840
  misc_feature 33..113: est; blastn; identity 98; region 1..81
  id T08840
  misc_feature 101..249: est; blastn; identity 95; region 72..220
  id HSC0CF041
  misc_feature 31..112: est; blastn; identity 100; region 1..82; id HSC0CF041; est
aagctaggacattcttctcctcctggccctggacatcagaaccccaggctctccagcctttggacttcaggactgacacaagcaacctgctgggttcttaggcctttggcttgtactgagacttacaccatcagcttccctggtcctgagacttttggacttggattgagccacgctactggcatcccaggatctccagcttgcagacagcctgtcgtgggacttcacagcctccataattatagaatggcaatggtctctgcgatgtcctgggtcctgtatttgtggataagtgcttgtgcaatgctactctgccatggatcccttcagcgg

SEQ ID NO: 219 - DNA, 284 bp, Homo Sapiens
  Brain
  sig_peptide 51..257: Von Heijne matrix
  score 5.70
  misc_feature complement(2..282): seq LCRLLCLVRLFCC/SS; blastn; identity 100; region 59..339
  id H10776
  misc_feature complement(64..282): est; blastn; identity 96; region 73..291
  id N94455
  misc_feature complement(2..85): est; blastn; identity 95; region 271..354
  id N94455
  misc_feature complement(107..282): est; blastn; identity 99; region 58..233
  id H64097
  misc_feature complement(2..120): est; blastn; identity 94; region 219..337
  id H64097
  misc_feature complement(38..282): est; blastn; identity 99; region 60..304
  id R98226
  misc_feature complement(161..282): est; blastn; identity 96; region 33..154
  id W60134
  misc_feature complement(9..120): est; blastn; identity 96; region 195..306; id W60134; est
atcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccagggg

SEQ ID NO: 220 - DNA, 361 bp, Homo Sapiens
  Brain
  sig_peptide 167..229: Von Heijne matrix
  score 5.60
  misc_feature 137..358: seq LVLSLQFLLLSYD/LF; blastn; identity 97; region 151..372
  id N33828
  misc_feature 2..124: est; blastn; identity 99; region 14..136
  id N33828
  misc_feature 138..358: est; blastn; identity 98; region 147..367
  id N34173
  misc_feature 1..148: est; blastn; identity 98; region 11..158
  id N34173
  misc_feature 35..358: est; blastn; identity 99; region 1..324
  id T89546
  misc_feature 138..337: est; blastn; identity 98; region 107..306
  id H67305
  misc_feature 42..148: est; blastn; identity 99; region 12..118
  id H67305
  misc_feature 138..302: est; blastn; identity 98; region 112..276
  id T79378
  misc_feature 33..145: est; blastn; identity 100; region 8..120
  id T79378
  misc_feature 317..348: est; blastn; identity 100; region 293..324; id T79378; est
aatgacaaccgacgttggagtttggaggtgcttgccttagagcaagggaaacagctctcattcaaaggaactagaagcctctccctcagtggtagggagacagccaggagcggttttctgggaactgtgggatgtgcccttgggggcccgagaaaacagaaggaagatgctccagaccagtaactacagcctggtgctctctctgcagttcctgctgctgtcctatgacctctttgtcaattccttctcagaactgctccaaaagactcctgtcatccagcttgtgctcttcatcatccaggatattgcagtcctcttcaacatcatcatcattttcctcatgttcttcaacacctcccgg

SEQ ID NO: 221 - DNA, 252 bp, Homo Sapiens
  Brain
  sig_peptide 172..243: Von Heijne matrix
  score 5.50
  misc_feature complement(100..250): seq MGVCLLIPGLATA/CI; blastn; identity 95; region 256..406
  id W72958
  misc_feature 115..250: est; blastn; identity 99; region 2..137
  id W78821
  misc_feature 120..250: est; blastn; identity 99; region 1..131
  id AA083784
  misc_feature 115..250: est; blastn; identity 98; region 4..139
  id W24219
  misc_feature 145..250: est; blastn; identity 97; region 39..144
  id C15963
  misc_feature 114..153: est; blastn; identity 95; region 9..48; id C15963; est
agcgcgasgyccgkctctcttgtgccctagcagattccgtcgcttcttccggagccgtacgtggtaccgccccgctcgcgggcggccgcgrggcttgctgggaagagaggcgaaccaggtcacctttcaaggacccagaagtagggttttggcctaggtaacggggcagagatgtggttcgagattctccccggactctccgtcatgggcgtgtgcttgttgattccaggactggctactgcgtgcatccgg

SEQ ID NO: 222 - DNA, 167 bp, Homo Sapiens
  Brain
  sig_peptide 30..95: Von Heijne matrix
  score 5.50
  misc_feature complement(2..103): seq LADPLXLFPFSEG/LP; blastn; identity 98; region 48..149
  id AA126155
  misc_feature complement(98..143): est; blastn; identity 95; region 7..52
  id AA126155
  unsure -8: est; position -8 of amino acid sequence; Xaa = Cys,Phe
actgctcstggagctctgcgctggtcttcatgcgccctagccctctttcggggatactggccgaccccctctkccttttcccctttagtgaaggcctcccccgtcgccgcgcggcttcccggagccgactgcagactccctcagcccggtgttccccgcgtccgggg

SEQ ID NO: 223 - DNA, 350 bp, Homo Sapiens
  Brain
  sig_peptide 261..341: Von Heijne matrix
  score 5.40
  misc_feature 40..352: seq SLMMAQXFIPAVA/KV; blastn; identity 96; region 30..342
  id H15315
  misc_feature 12..46: est; blastn; identity 91; region 1..35
  id H15315
  misc_feature 77..300: est; blastn; identity 96; region 1..224
  id HUM427H08B
  misc_feature 22..134: est; blastn; identity 91; region 3..115
  id AA071651
  misc_feature 138..326: est; blastn; identity 95; region 32..220
  id R35596
  misc_feature 65..111: est; blastn; identity 91; region 1..47
  id W55530
  est
  misc_feature 109..110: n=a, g, c or t
  unsure -21: position -21 of amino acid sequence
  unsure -7: Xaa = Cys,Phe,Gly,Ile,Leu,Met,Arg,Ser,Val,Trp; position -7 of amino acid sequence; Xaa = Gly,Val
aggagggctggacagcagctcagctcgctagctgcgcgcttcccggcacaggcagtgccactgcgcaggttgatcagcgaaacagcatccattttaatctgcggggagnncctgccttaccagggcgttctctccgcccgccggtggatgctccgcgcctgcsctccgcagcctcgctcagcagtcctgcgttggggtctgcgccctaggatgcactgagatggtacatcaggataactgctcgtatcaggcacagaaaaatgagagagagtctatcadksagaagttggcacttgccagcttctttgatgatggcccaggkatttataccagctgtagcaaaagtagga

SEQ ID NO: 224 - DNA, 430 bp, Homo Sapiens
  Brain
  sig_peptide 251..424: Von Heijne matrix
  score 5.40
  misc_feature 226..295: seq LSLHLLATRACYG/IL; blastn; identity 95; region 121..190
  id W07343
  est
  misc_feature 290: n=a, g, c or t
  unsure -45: position -45 of amino acid sequence
  unsure -22: Xaa = Cys,Gly,Arg,Ser; position -22 of amino acid sequence; Xaa = Ala,Gly,Leu,Met,Arg,Ser,Thr,Val,Trp
aacaggtggttgcagaagtttcgtggtgtcgggcgcgcgtctgcactgcagacgcagagggtttgggagcgagcagtttcctgcccagggatgggggtcctggctgcacttcacgggggcggccctttcgtttcgctctgcgtgacaggtctcgcttgattgggtttctcatgggtskctggcgtttctacggcgcggctctcacggactcaggccaggccactcgcaggattaattggaattcttcaaaatgtcaggtgtggtacccacagcccctgaacagcctgcangtgaaatggaaaatcaaacaaaaccaccagatccaaggcctgatgctcctcctgaatacagttctcatdbgtttaccaggaccccctggaaacagctgtccctccacctactggctaccagagcttgctatgggatacta

SEQ ID NO: 225 - DNA, 387 bp, Homo Sapiens
  Brain
  sig_peptide 139..369: Von Heijne matrix
  score 5.30
  misc_feature complement(75..325): seq TWVFTCLVFFCFG/LS; blastn; identity 100; region 82..332
  id AA004751
  misc_feature complement(88..255): est; blastn; identity 97; region 153..320
  id N27443
  misc_feature complement(18..105): est; blastn; identity 94; region 304..391
  id N27443
  misc_feature complement(258..325): est; blastn; identity 100; region 81..148
  id N27443
  misc_feature complement(22..325): est; blastn; identity 99; region 80..383
  id AA015608
  misc_feature complement(78..253): est; blastn; identity 99; region 165..340
  id H09727
  misc_feature complement(253..285): est; blastn; identity 96; region 132..164
  id H09727
  misc_feature complement(49..276): est; blastn; identity 97; region 133..360
  id AA027099
  misc_feature complement(269..325): est; blastn; identity 100; region 83..139
  id AA027099
  unsure 3: est; position 3 of amino acid sequence; Xaa = Pro,Thr
agaaacagggagaagaggaaggctagaagcctgagcaagtgagggtagaaccttttgggactggcctttgaagctctggccagggatggggtgggggccaaaaggacagagcctggtatgtcttcatagtcattgagaatgtggagataccagtttgggtggggggtgatcaccaggggacctagggagatccccttcccaccctctctgttggcctcagagtcactcctgccccctctccctgacttggtgctcacatgcacctcactagggtttgtgaccagggtctggatgagcttgaatttgaatgaattgagtttgtattctagaacctgggtttttacatgtttggtctttttttgttttggkttgtcamcctcgctaggg

SEQ ID NO: 226 - DNA, 300 bp, Homo Sapiens
  Brain
  sig_peptide 184..270: Von Heijne matrix
  score 5.20
  misc_feature 123..295: seq FFMLLGSLLPVKI/IE; blastn; identity 97; region 121..293
  id N78275
  misc_feature 43..128: est; blastn; identity 100; region 40..125
  id N78275
  misc_feature 19..295: est; blastn; identity 99; region 4..280
  id R35388
  misc_feature 40..295: est; blastn; identity 98; region 14..269
  id W03418
  misc_feature 29..283: est; blastn; identity 98; region 27..281
  id HSC29H041
  misc_feature 49..266: est; blastn; identity 96; region 78..295; id R60376; est
aagactgcgcggccgtwgggcgtgcagcggcgccagtcggcggacgaggggcccccgggagttgctggactgagacatgagcctccaactgtgtggttgggctcggtagcacatcgtgggacttgggtgtgcgcccacagatggtttggccctgcagtgaccagagcagcccaagccgccaccatggtgaaattgctagtggccaaaatcctgtgcatggtgggcgtgttcttcttcatgctgctcggctccctgctccccgtgaagatcatcgagacagattttgagaaggccccaggg

SEQ ID NO: 227 - DNA, 76 bp, Homo Sapiens
  Brain
  sig_peptide 11..61: Von Heijne matrix
  score 5.20
  misc_feature complement(2..73): seq IMCLIGLKANASS/ET; blastn; identity 98; region 40..111
  id HSC39G092
  misc_feature complement(2..73): est; blastn; identity 98; region 37..108; id T89094; est
atccttttgcatgcctgtttctatcatgtgcttgataggcctcaaagctaatgcttccagtgaaacacactcaggg

SEQ ID NO: 228 - DNA, 125 bp, Homo Sapiens
  Brain
  sig_peptide 48..98: Von Heijne matrix
  score 5.20
  misc_feature 11..120: seq LLYLVLEKLVSRA/FQ; blastn; identity 100; region 1..110; id HSC3IG111; est
agatactaatcctttaaaaaagtgtaaatggagaaaagttatattttatgaaggttattttgttgtatttagtattggaaaagttggtttccagagcatttcagaatgtcgaagcaccacacggg

SEQ ID NO: 229 - DNA, 170 bp, Homo Sapiens
  Brain
  sig_peptide 33..89: Von Heijne matrix
  score 5.10
  misc_feature 81..170: seq LLLGGRVCXPSLA/VG; blastn; identity 97; region 54..143
  id T09307
  misc_feature 29..81: est; blastn; identity 92; region 1..53
  id T09307
  misc_feature 12..77: est; blastn; identity 98; region 1..66
  id AA159859
  misc_feature 28..75: est; blastn; identity 95; region 1..48
  id H13321
  misc_feature 15..75: est; blastn; identity 93; region 10..70
  id W02365
  misc_feature 33..77: est; blastn; identity 95; region 1..45
  id AA113927
  unsure -5: est; position -5 of amino acid sequence; Xaa = Ala,Pro
aagccgayygctgaaggctggtttgcgtcgacatggcggttaccctgagtctcttgctgggcgggcgcgtttgcscgccgtcactcgctgtgggttcgcgacccggggggtggcgggcccaggccctattggccgggagccggaccccgattccgactgggaaccggagg

SEQ ID NO: 230 - DNA, 263 bp, Homo Sapiens
  Brain
  sig_peptide 117..185: Von Heijne matrix
  score 5.10
  misc_feature 57..261: seq LLPELGVVTPAQG/PR; blastn; identity 97; region 40..244
  id R59037
  misc_feature complement(184..237): est; blastn; identity 100; region 38..91; id R67654; est
aagaccatcaactatggaaaggagatctagggaacaccgtcttgaacccgccagggttttgagtctcggacccaggagatccaaccctgaccaccctcccaggatgcagcagggggatgttaaatcagacttcaggaagaacttccttgctgcctgagttaggtgtcgtcacgcctgcccaggggccaaggaggcgggtttggtgcggccactccaaggccaaagcgagaaaatcttactgcgcacgcgcaatagactgccag

SEQ ID NO: 231 - DNA, 430 bp, Homo Sapiens
  Brain
  sig_peptide 26..262: Von Heijne matrix
  score 5.00
  misc_feature 99..416: seq SFLGFSAPTPIQA/LT; blastn; identity 99; region 1..318
  id T31969
  misc_feature 49..334: est; blastn; identity 99; region 2..287
  id HSB03B072
  misc_feature complement(2..57): est; blastn; identity 100; region 1..56; id W51830; est
atgtgatgatccggaggctggggagatgacatcagaaaacctggtccaaactgctccaaaaaagaagaaaaataaagggaaaaaagggttggagccttctcagagcactgctgccaaggtgcccaaaaaagcgaagacatggattcctgaagttcatgatcagaaagcagatgtgtcagcttggaaggacctgtttgttcccaggccggttctccgagcactcagctttctaggcttctctgcacccacaccaatccaagccctgaccttggcacctgccatccgtgacaaactggacatccttggggctgctgagacaggaagtgggaaaactcttgcctttgccatcccaatgattcatgcggtgttgcagtggcagaagaggaatgctgcccctcctccaagtaacaccgaagcaccacctggagag

SEQ ID NO: 232 - DNA, 252 bp, Homo Sapiens
  Brain
  sig_peptide 16..84: Von Heijne matrix
  score 4.90
  misc_feature 1..37: seq WHXLIPLTWACMA/RQ; blastn; identity 97; region 9..45
  id W84513
  unsure -16: est
  position -16 of amino acid sequence
  unsure -15: Xaa = Ala,Pro
  position -15 of amino acid sequence
  unsure -14: Xaa = Phe,Leu
  position -14 of amino acid sequence
  unsure -11: Xaa = Asn,Ser
  position -11 of amino acid sequence
  unsure 17: Xaa = Leu,Arg; position 17 of amino acid sequence; Xaa = Leu,Trp
aatcttctccgcgctatggctgcgttcggccgtcagscwttsarttggcacckyctgatccccctcacctgggcctgtatggctaggcagactcctcatcttggagaacagagaaggacgacagcttctttgtkgcgcaaactgactacagcctccaatggaggggtcattgaggagttatcttgtgtkagatccaataactatgtgcaggaaccagagtgcaggaggaatcttgttcagtgcctcctctgg

SEQ ID NO: 233 - DNA, 347 bp, Homo Sapiens
  Brain
  sig_peptide 144..314: Von Heijne matrix
  score 4.90
  misc_feature 44..187: seq GWFLSGCPHGSSA/TW; blastn; identity 96; region 1..144
  id AA151232
  misc_feature 187..285: est; blastn; identity 97; region 143..241
  id AA151232
  misc_feature 314..349: est; blastn; identity 100; region 272..307
  id AA151232
  misc_feature 39..225: est; blastn; identity 95; region 2..188; id AA040887; est
aatggggatgttgaatttggaaattggaggggacgctggtggwykkattgggtgcaaggagttggtgttgatggaggagcaggasrccagagtcccagccctggaaccgttcagagtggagcaggcaccacctgtaatctactatgtccctgacttcatctccaaagaagaggaggagtatttgcttcgacaggtttttaatgccccaaagccaaagtggacccagctctctgggagaaagttacagaactggggtgggcttcctcatccccgagggatggttcctgagcggctgcccccatggctccagcgctacgtggacaaagtgtcaaacctcagcctctttg

SEQ ID NO: 234 - DNA, 227 bp, Homo Sapiens
  Brain
  sig_peptide 90..206: Von Heijne matrix
  score 4.80
  misc_feature 115..226: seq SLXFCLSPPPSPS/LR; blastn; identity 95; region 135..246
  id HSC0GF021
  unsure -11: est; position -11 of amino acid sequence; Xaa = Ala,Thr
aaaccccataccccctccccatcttgtgatcaccctcattacctcttctgggccccctgtggacctgcgttgacccagcatgggctacaatgggggagttgggtaatcgctcccgttgcatcctgtttctgtctgaaaacccttgtctttctgaatccatctttcagtctctsrcattctgtctttcccctcctccttcaccttccctccgtccctctccctcacgg

SEQ ID NO: 235 - DNA, 430 bp, Homo Sapiens
  Brain
  sig_peptide 98..376: Von Heijne matrix
  score 4.70
  misc_feature 101..355: seq VLLLRQXFAQAEK/WY; blastn; identity 99; region 83..337
  id AA057242
  misc_feature 57..101: est; blastn; identity 100; region 40..84
  id AA057242
  misc_feature 357..400: est; blastn; identity 100; region 338..381
  id AA057242
  misc_feature 18..51: est; blastn; identity 100; region 1..34
  id AA057242
  misc_feature 400..431: est; blastn; identity 100; region 382..413
  id AA057242
  misc_feature 84..218: est; blastn; identity 97; region 73..207
  id R09808
  misc_feature 10..51: est; blastn; identity 100; region 1..42
  id R09808
  est
  misc_feature 356: n=a, g, c or t
  unsure -7: position -7 of amino acid sequence; Xaa = Leu,Met,Val
aattttcygtggtccaactaccctcggcgatcccaggcttggcggggcaccgcctggcctctcccgttcctttaggctgccgccgctgcctgccgccatggcagagttgggcctaaatgagcaccatcaaaatgaagttattaattatatgcgttttgctcgttcaaagagaggcttgagactcaaaactgtagattcctgcttccaagacctcaaggagagcaggctggtggaggacaccttcaccatagatgaagtctctgaagtcctcaatggattacaagctgtggttcatagtgaggtggaatctgagctcatcaacactgcctataccaatgtgttacttctgcgacagntgtttgcacaagctgagaagtggtatcttaagctacagacagacatctctgaacttgaaaaccgagaattatta

SEQ ID NO: 236 - DNA, 344 bp, Homo Sapiens
  Brain
  sig_peptide 135..281: Von Heijne matrix
  score 4.60
  misc_feature 20..231: seq SWAVGLLYAVAQG/SK; blastn; identity 99; region 1..212
  id N33729
  est
  misc_feature 318: n=a, g, c or t
  unsure 13: position 13 of amino acid sequence; Xaa = Cys,Gly,Arg,Ser
aattagcgaggccatgggggaaaaagtctaactggcggaactcctgggaactggggcgatgggctcttagtatcggaggattggagccatctgatttttacctgaaattccttagtctctcctgtgttggggaaatggtcaccttgccttcagggacctgggctttcagctgtccatacctggccctggttgatggcggcatgctgggcagtgcacgtgaagacgcacatgcatctgttgtttcctgggcagttggtcttctttatgcagtggctcagggctccaagagaaggaaagtgcaagatgtcaagcctcttngttggtcaagaactggcaccctcggg

SEQ ID NO: 237 - DNA, 419 bp, Homo Sapiens
  Brain
  sig_peptide 180..383: Von Heijne matrix
  score 4.60
  misc_feature 116..419: seq LPFSLVSMLVTQG/LV; blastn; identity 98; region 122..425
  id W68799
  misc_feature 18..117: est; blastn; identity 97; region 1..100
  id W68799
  misc_feature 18..209: est; blastn; identity 93; region 1..192
  id W49697
  misc_feature 199..290: est; blastn; identity 95; region 183..274
  id W49697
  misc_feature 291..367: est; blastn; identity 97; region 276..352
  id W49697
  misc_feature 387..417: est; blastn; identity 100; region 374..404
  id W49697
  misc_feature 48..419: est; blastn; identity 98; region 1..372
  id AA149518
  misc_feature 171..414: est; blastn; identity 97; region 116..359
  id W17032
  misc_feature 57..174: est; blastn; identity 97; region 1..118
  id W17032
  misc_feature 78..386: est; blastn; identity 98; region 1..309
  id W78749
  misc_feature 386..419: est; blastn; identity 100; region 310..343
  id W78749
  est
  misc_feature 270..271: n=a, g, c or t
  unsure -39: position -39 of amino acid sequence
  unsure -38: Xaa =  * ,Ser,Tyr; position -38 of amino acid sequence; Xaa =  * ,Ala,Glu,Gly,Ile,Lys,Leu,Pro,Gln,Arg,Ser,Thr,Val
aagacaggtggggtactcgggaagctggagcgggccggcggtgcagtcacgggggagcgaggcctgctgggcttggcaacgagggactcggcctcggaggcgacccagaccacacagacactgggtcaaggagtaagcagaggataaacaactggaaggagagcaagcacaaagtcatcatggcttcagcgtctgctcgtggaaaccaagataaagatgcccattttccaccaccaagcaagcagagcctgttgttttgtccaaaatmhnnactgcacatccacagagcagagatctcaaagattatgcgagaatgtcaggaagaaagtttctggaagagagctctgcctttttctcttgtaagcatgcttgtcacccagggactagtctaccaaggttatttggcagctaattctaga

SEQ ID NO: 238 - DNA, 274 bp, Homo Sapiens
  Brain
  sig_peptide 62..268: Von Heijne matrix
  score 4.50
  misc_feature complement(37..269): seq FILSLCVLCIVLT/TG; blastn; identity 99; region 2..234
  id AA147071
  misc_feature complement(2..31): est; blastn; identity 93; region 239..268
  id AA147071
  misc_feature complement(37..269): est; blastn; identity 99; region 58..290
  id H98153
  misc_feature complement(2..31): est; blastn; identity 93; region 295..324
  id H98153
  misc_feature complement(37..269): est; blastn; identity 98; region 59..291
  id N49401
  misc_feature complement(2..31): est; blastn; identity 93; region 296..325
  id N49401
  misc_feature complement(87..269): est; blastn; identity 99; region 37..219; id N80022; est
aattaagtcakdatacaaatcagcacagataacgdmaatgtttccaatatwwtaaaatgtaatgttacttatgaaaagtattttgcttaaggttgtgtgtgtattgtgtatatacctcaagttcaagttaatggcattgatttatgttccagacaaaaataacacaaataataatatccttcgttataaccacaatgagataagtattggcattagtgttcagtgccattttatactttctctctgtgttctctgtattgtactaaccactggg

SEQ ID NO: 239 - DNA, 249 bp, Homo Sapiens
  Brain
  sig_peptide 100..147: Von Heijne matrix
  score 4.50
  misc_feature 100..249: seq RLLLRRFLASVIS/RK; blastn; identity 94; region 20..169
  id N41898
  misc_feature 113..249: est; blastn; identity 94; region 38..174
  id H69272
  unsure 20: est
  position 20 of amino acid sequence
  unsure 23: Xaa =  * ,Gln; position 23 of amino acid sequence; Xaa = Pro,Ser
agttatgtacgttcccccccccgaggaagtgaygacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccayaatgcagtyctggtggcctgactgtaacacccaacccaagccgg

SEQ ID NO: 240 - DNA, 310 bp, Homo Sapiens
  Brain
  sig_peptide 2..232: Von Heijne matrix
  score 4.40
  misc_feature 51..209: seq FEARIALLPLLQA/ET; blastn; identity 99; region 49..207
  id N56053
  misc_feature 2..54: est; blastn; identity 96; region 1..53
  id N56053
  misc_feature 211..246: est; blastn; identity 100; region 208..243
  id N56053
  misc_feature 275..307: est; blastn; identity 96; region 270..302
  id N56053
  misc_feature 51..178: est; blastn; identity 98; region 44..171
  id R59444
  misc_feature 212..275: est; blastn; identity 100; region 203..266
  id R59444
  misc_feature 7..54: est; blastn; identity 95; region 1..48
  id R59444
  misc_feature 274..308: est; blastn; identity 100; region 266..300
  id R59444
  misc_feature 178..209: est; blastn; identity 100; region 170..201
  id R59444
  misc_feature 51..178: est; blastn; identity 98; region 45..172
  id AA156837
  misc_feature 178..246: est; blastn; identity 100; region 171..239
  id AA156837
  misc_feature 247..308: est; blastn; identity 100; region 239..300
  id AA156837
  misc_feature 6..54: est; blastn; identity 95; region 1..49
  id AA156837
  misc_feature 51..178: est; blastn; identity 99; region 56..183
  id N88392
  misc_feature 13..54: est; blastn; identity 95; region 19..60
  id N88392
  misc_feature 247..285: est; blastn; identity 100; region 249..287
  id N88392
  misc_feature 211..246: est; blastn; identity 100; region 214..249
  id N88392
  misc_feature 179..209: est; blastn; identity 100; region 183..213
  id N88392
  misc_feature 7..209: est; blastn; identity 98; region 1..203
  id R18752
  misc_feature 211..246: est; blastn; identity 100; region 204..239
  id R18752
  unsure -65: est; position -65 of amino acid sequence; Xaa = Pro,Thr
aatggcggcgtcaaaggtgaagcaggacatgcctccrmcggggggctatgggcccatcgactacaaacggaacttgccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggaggaccttgcagatgcttcgggagaacctggaggaggaggccatcatcatgaaggacgtgcccgga

SEQ ID NO: 241 - DNA, 388 bp, Homo Sapiens
  Brain
  sig_peptide 158..319: Von Heijne matrix
  score 4.30
  misc_feature 93..257: seq LLSLAILSHISTP/GC; blastn; identity 99; region 103..267
  id H87397
  unsure 12: est; position 12 of amino acid sequence; Xaa = Asp,His,Tyr
agacaaagagaaggcaaaatsagtttgtgtccctgagttgctaagtggagaagaaacgtccaccaaccaggaaacacctgcctccaactgttaataggtctgtgaaatgtgctttgtttctggtcagcatggacacccgctttaatagtggcttcagatgaggcaccttgtgacagaggagctcttcccctgcagcaaccttgaagatgttgtggaagacaatagccattcttacttcactctgaggatcacgatggcgtgcaagggtgtgccaagcacattgctatctttggccattctctctcacattagtacacctggatgtgaatggcacgttatctatgtaagcagtbatggtctctatcttgtggtagaaatgacagaccgg

SEQ ID NO: 242 - DNA, 391 bp, Homo Sapiens
  Brain
  sig_peptide 152..379: Von Heijne matrix
  score 4.30
  misc_feature 108..392: seq FRLLXVFAYGTYA/DY; blastn; identity 98; region 104..388
  id T08101
  misc_feature 32..110: est; blastn; identity 98; region 1..79
  id T08101
  misc_feature 108..392: est; blastn; identity 98; region 39..323
  id T27149
  misc_feature 113..392: est; blastn; identity 98; region 30..309
  id H06555
  misc_feature 108..316: est; blastn; identity 99; region 90..298
  id HSC3CC081
  misc_feature 60..110: est; blastn; identity 94; region 15..65
  id HSC3CC081
  misc_feature 105..316: est; blastn; identity 99; region 58..269
  id T74159
  misc_feature 76..105: est; blastn; identity 93; region 5..34
  id T74159
  est
  misc_feature 326: n=a, g, c or t
  unsure -18: position -18 of amino acid sequence
  unsure -9: Xaa = Asp,His,Asn,Tyr
  position -9 of amino acid sequence
  unsure 3: Xaa = Lys,Thr; position 3 of amino acid sequence; Xaa =  * ,Leu
aagtggccagagcgactcttcagggaggtggcaggaaaggcttggaacagctgccggaggtgacggagcggcggccccgcccggtgcgctggaggtcgaagcttccagctctggacatcctgagcccaagtcccccacactcagtgcagtgatgagtgcggaagtgaaggtgacagggcagaaccaggagcaatttctgctcctagccaagtcggccaagggggcagcgctggccacactcatccatcaggtgctggaggcccctggtgtctacgtgtttggagaactgctggacatgcccaatgttagagagctggctgagagtnactttgcctctaccttccggctgctcamagtgtttgcttatgggacatacgctgactactwagct

SEQ ID NO: 243 - DNA, 299 bp, Homo Sapiens
  Brain
  sig_peptide 165..266: Von Heijne matrix
  score 4.30
  misc_feature 47..248: seq QLFAFLNLLPVEA/DI; blastn; identity 97; region 15..216
  id HUM429E03B
  misc_feature 244..299: est; blastn; identity 94; region 211..266
  id HUM429E03B
  misc_feature 133..299: est; blastn; identity 97; region 107..273
  id T80259
  misc_feature 47..139: est; blastn; identity 92; region 22..114
  id T80259
  misc_feature 48..292: est; blastn; identity 94; region 1..245
  id T31768
  misc_feature 111..299: est; blastn; identity 94; region 47..235
  id N32697
  misc_feature 64..106: est; blastn; identity 97; region 1..43
  id N32697
  misc_feature 74..299: est; blastn; identity 94; region 1..226
  id N44613
  unsure -19: est
  position -19 of amino acid sequence
  unsure -15: Xaa =  * ,Tyr
  position -15 of amino acid sequence
  unsure 3: Xaa = Ser,Thr; position 3 of amino acid sequence; Xaa = Leu,Val
acttccgcttcgcctaggtgttgtcgtccctgctagtactccgggctgggggtcggtgcggatattcagtcatgaaatcasggtagggacttctcccgcagcgacgcggctggcaagactgtttgtgtwgcgggggccggacttcaaggtgattttacaacgagatgctgctctccatagggatgctcatgctgtcagccacacaagtstasaccatcttgastgtccagctctttgcattcttaaacctactgcctgtagaagcagacattktagcatataactttgaaaatgcatct

SEQ ID NO: 244 - DNA, 312 bp, Homo Sapiens
  Brain
  sig_peptide 229..276: Von Heijne matrix
  score 4.20
  misc_feature complement(115..313): seq EVVSLSYCGVSWG/RI; blastn; identity 98; region 1..199
  id H19659
  misc_feature complement(2..102): est; blastn; identity 97; region 212..312
  id H19659
  misc_feature complement(115..313): est; blastn; identity 97; region 1..199
  id R72881
  misc_feature complement(115..290): est; blastn; identity 98; region 1..176
  id H50517
  misc_feature complement(44..102): est; blastn; identity 100; region 189..247
  id H50517
  misc_feature complement(115..302): est; blastn; identity 96; region 36..223
  id H41556
  misc_feature complement(115..313): est; blastn; identity 95; region 2..200
  id R71794
  misc_feature complement(44..102): est; blastn; identity 96; region 213..271; id R71794; est
acatttctgctcagattcccgccatctccattgcattcatgtactaccctcagtctacactcacaatcatcttctcccaagactgctcccttttgttttgtgtttttttgaggggaattaaggaaaaataagtgggggcaggtttggagagctgcttccagtggatagttgatgagaatcctgaccaaaggaaggcacccttgactgtygggatagacagatggacctatggggtgggaggtggtgtccctttcatactgtggtgtctcttggggaaggatctccccgaatctcaataaaccagtgaacagg

SEQ ID NO: 245 - DNA, 252 bp, Homo Sapiens
  Brain
  sig_peptide 37..132: Von Heijne matrix
  score 4.20
  misc_feature 41..210: seq CWELFCLEHGIQA/DG; blastn; identity 98; region 77..246
  id R59124
  unsure 34: est; position 34 of amino acid sequence; Xaa = Cys,Ser
aaagctgagaggkgcgcgggcgaggacagcggcasratgcgggaatgcatatcagtccacgtgggccaagcgggagtdcagattggcaatgcctgctgggagctcttctgcctggaacacggcatccaggcagacggcacttttgatgctcaagctagcaagatcaacgatgatgactccttcaccacctttttcagcgagactggcacttctctgctgatggaacgcctctscctggattatggcaagaaa

SEQ ID NO: 246 - DNA, 172 bp, Homo Sapiens
  Brain
  sig_peptide 35..109: Von Heijne matrix
  score 4.20
  misc_feature 82..168: seq LDLLRGLPRVSLA/NL; blastn; identity 96; region 107..193
  id AA088577
  misc_feature 31..71: est; blastn; identity 92; region 53..93
  id AA088577
  misc_feature 31..168: est; blastn; identity 97; region 24..161
  id R16448
  misc_feature 53..168: est; blastn; identity 99; region 23..138
  id AA094092
  misc_feature 31..163: est; blastn; identity 96; region 24..156
  id R18030
  misc_feature 60..168: est; blastn; identity 97; region 43..151
  id W00599
  misc_feature 29..70: est; blastn; identity 95; region 13..54; id W00599; est
aagggcgcccttgaaagttcttggatctgcgggtatggccggtcccttgcagggcggtggggcccgggccctggacctactccggggcctgccgcgtgtgagcctggccaacttaaagccgaatcccggctccaagaaaccggagagaagaccaagaggtcggagaaggtgg

SEQ ID NO: 247 - DNA, 359 bp, Homo Sapiens
  Brain
  sig_peptide 156..230: Von Heijne matrix
  score 4.20
  misc_feature 52..360: seq MFAASXLAMCAGA/EV; blastn; identity 98; region 1..309
  id HSC1ED081
  misc_feature 171..316: est; blastn; identity 98; region 146..291
  id AA143136
  misc_feature 31..165: est; blastn; identity 97; region 6..140
  id AA143136
  misc_feature 310..341: est; blastn; identity 96; region 286..317
  id AA143136
  misc_feature 176..282: est; blastn; identity 99; region 77..183
  id N75929
  misc_feature 102..165: est; blastn; identity 98; region 3..66
  id N75929
  unsure -8: est; position -8 of amino acid sequence; Xaa = Ile,Leu
attttgggtccggcctgctcgcmgtccgctccgtccgcccttagacctgttgcccagcatccctgcagttcgcggwacagtctctattagagcgcgtgtatagaggcagakaggagtgaagtccacagttcctctcctcctagagcctgccgaccatgcccgcgggcgtgcccatgtccacctacctgaaaatgttcgcagccagtmtcctggccatgtgcgcaggggcagaagtggtgcacaggtactaccgaccggacctgacaatacctgaaattccaccaaagcgtggagaactcaaaacggagcttttgggactgaaagaaagaaaacacaaacctcaagtttctcaacaggag

SEQ ID NO: 248 - DNA, 284 bp, Homo Sapiens
  Brain
  sig_peptide 39..110: Von Heijne matrix
  score 4.20
  misc_feature 10..280: seq SLPALALSLRASP/RX; blastn; identity 98; region 17..287
  id AA082102
  misc_feature 72..224: est; blastn; identity 98; region 30..182
  id R10417
  misc_feature 221..280: est; blastn; identity 100; region 180..239
  id R10417
  misc_feature 47..280: est; blastn; identity 99; region 2..235
  id W73318
  misc_feature 42..224: est; blastn; identity 97; region 1..183
  id R08733
  misc_feature 237..269: est; blastn; identity 93; region 198..230
  id R08733
  unsure 2: est; position 2 of amino acid sequence; Xaa = Leu,Val
aagtgcgtgcgcggcgactgcgacgggcagtggcagtcatggcggttcagtgcgtgaggttggcgcggcgcagtcttcctgctttggcgttgtctctcagggcatctccccggktgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggaaaaatataaacgagcgagg

SEQ ID NO: 249 - DNA, 307 bp, Homo Sapiens
  Brain
  sig_peptide 182..292: Von Heijne matrix
  score 4.20
  misc_feature complement(34..74): seq RLMHHYLSTPTSA/RP; blastn; identity 92; region 271..311; id T05270; est
aaaggctgccctgtggcaccacaatctaagctcagggcataaaaccccttgtggctttgatggaatccagggctcagaccataaaacccctcgtggccttttgaatgtgcaccgacttgctggctccttgcttcttgctctcccagaatcgtaaattgattgtatcttgagttggaagaacatgttctccattatctcacgtagcagagcatgttccatgtacttcaaagaaaatgctaaaccgtcacagctacgcttgatgcaccactacctttctacccccacatccgcacgtcctcaccacctg

SEQ ID NO: 250 - DNA, 212 bp, Homo Sapiens
  Brain
  sig_peptide 108..155: Von Heijne matrix
  score 4.10
  misc_feature complement(1..209): seq LLPATSLAGPVLS/TL; blastn; identity 99; region 125..333
  id H40205
  misc_feature complement(80..209): est; blastn; identity 96; region 131..260
  id H03462
  misc_feature complement(52..90): est; blastn; identity 97; region 251..289
  id H03462
  misc_feature complement(17..54): est; blastn; identity 97; region 288..325
  id H03462
  misc_feature complement(17..209): est; blastn; identity 95; region 130..322
  id R05443
  misc_feature complement(128..209): est; blastn; identity 98; region 143..224
  id T52770
  misc_feature complement(80..128): est; blastn; identity 100; region 225..273
  id T52770
  misc_feature complement(43..74): est; blastn; identity 96; region 281..312
  id T52770
  misc_feature complement(57..209): est; blastn; identity 98; region 143..295; id AA037595; est
acttcttgtggactcaccaagagaaacaaaaggaagcctgcaccattgtagccctgaactcttttctgggcacctgaatcccaggaaccctcaatgaggtcttcaagatgaagagactgctgccagctaccagcctggctggccctgtcctgtccaccctcattgccccaactcccatgttgttttgtgaagataaaagctgggatcctggg

SEQ ID NO: 251 - DNA, 357 bp, Homo Sapiens
  Brain
  sig_peptide 64..273: Von Heijne matrix
  score 4.00
  misc_feature 108..308: seq IAVLYLHLYDVFG/DP; blastn; identity 95; region 116..316
  id HSC2TH021
  misc_feature 16..99: est; blastn; identity 97; region 24..107
  id HSC2TH021
  misc_feature 30..92: est; blastn; identity 92; region 72..134
  id W54529
  misc_feature 119..352: est; blastn; identity 98; region 23..256
  id R59681
  unsure -25: est
  position -25 of amino acid sequence
  unsure -24: Xaa = Leu,Pro,Arg; position -24 of amino acid sequence; Xaa = Pro,Arg,Thr
aactgtccggggctgcggggcttgcttccggcgtcatggctcaaagggccttcccgaatccttatgctgattataacaaatccctggccgaagtactttgatgctgccgggaggctgactcctgagttctcacaacgcttgaccaataagattcgggagcttcttcagcaaatggagagaggcctgaaatcagcagaccbbmsggatggcaccggttacactggctgggcaggtattgctgtgctttacttacatctttatgatgtatttggggaccctgcctacctacagttagcacatggctatgtaaagcaaagtctgaactgcttaaccaagcgctccatcaccttccaaggg

SEQ ID NO: 252 - DNA, 414 bp, Homo Sapiens
  Brain
  sig_peptide 274..336: Von Heijne matrix
  score 3.90
  misc_feature 11..238: seq AWLAQGSSSAGWG/LE; blastn; identity 100; region 1..228
  id R26618
  misc_feature 283..397: est; blastn; identity 98; region 96..210
  id HUM528H09B
  misc_feature 202..282: est; blastn; identity 98; region 16..96
  id HUM528H09B
  misc_feature 283..411: est; blastn; identity 96; region 110..238
  id C18739
  misc_feature 202..282: est; blastn; identity 98; region 30..110
  id C18739
  misc_feature 235..411: est; blastn; identity 97; region 1..177
  id R17985
  misc_feature complement(2..70): est; blastn; identity 97; region 9..77
  id R40947
  unsure 25: est; position 25 of amino acid sequence; Xaa = Ala,Pro,Ser
atcaattttktgaatagtttccatttcaaatatcttgttctacttggttcataaaatagtggttttcaaactgtagagctctggacttctcacttctagggcagagggagcctgaacaagtgaggctctgggttccccattcctaattaaaccaatggaaagaaggggtctaataacaaactacagcaacacatttttcatttcagcttcactgctgtatctcccagtctaaccctagcatccagaagtggcacaaaacccctctgctggctcatgtgtgcaactgagactgtcagagcatggctagctcaggggtccagctctgcagggtgggggctagagaggaagcagggagtatctgcacacaggatgcccgcgctcaggtggttgcagaagtcagtgccaggabccatg

SEQ ID NO: 253 - DNA, 189 bp, Homo Sapiens
  Brain
  sig_peptide 46..183: Von Heijne matrix
  score 3.90
  misc_feature 124..153: seq AAAFCLKXXGANT/HP; blastn; identity 90; region 25..54
  id N91869
  misc_feature 124..153: est; blastn; identity 90; region 5..34
  id H53427
  misc_feature 124..153: est; blastn; identity 90; region 19..48
  id H88369
  misc_feature 124..153: est; blastn; identity 90; region 26..55
  id T79771
  misc_feature 124..153: est; blastn; identity 90; region 29..58
  id H41152
  unsure -28: est
  position -28 of amino acid sequence
  unsure -6: Xaa = Cys,Tyr
  position -6 of amino acid sequence
  unsure -5: Xaa = Ile,Met; position -5 of amino acid sequence; Xaa = Ser,Thr
agaatttctcccactcttcgagcctacagcagacatgttaggagaatgctgctgcttgcaacacacccagagacggtggggcaggtgacactgcgtgtgtrcccggtgtctctggaagtgtctatacagatgtgtgctgctgctgctgctgctttctgccttaaaatkwctggagccaacacccaccca

SEQ ID NO: 254 - DNA, 300 bp, Homo Sapiens
  Brain
  sig_peptide 43..234: Von Heijne matrix
  score 3.90
  misc_feature 149..232: seq GLGGAQLQGGAXG/RG; blastn; identity 96; region 91..174
  id AA081517
  misc_feature 224..297: est; blastn; identity 97; region 165..238
  id AA081517
  misc_feature 90..141: est; blastn; identity 98; region 34..85
  id AA081517
  misc_feature 76..141: est; blastn; identity 93; region 20..85
  id N53273
  misc_feature 149..193: est; blastn; identity 97; region 91..135
  id N53273
  misc_feature complement(237..297): est; blastn; identity 100; region 172..232
  id H14293
  unsure -54: est
  position -54 of amino acid sequence
  unsure -53: Xaa = Ser,Thr
  position -53 of amino acid sequence
  unsure -2: Xaa = Gly,Arg; position -2 of amino acid sequence; Xaa =  * ,Trp
agtctctgggcgcggccatgttggaggstccgggcccgagtgatggctgcgagctcagcaaccccagcgccsascrgaagtcagcggtgcggggcagatgctggaagtgcagccaggattgtatttcggtggggccgcggccgtcgcggagccagatcacctgagggaagcgggcatcacggccgtgctaacagtggactcggaggagcccagcttcaaggcggggcctrgggtcgaggatctatggcgcctcttcgtgccagcgctggacaaacccgagacggacctactcagccaggg

SEQ ID NO: 255 - DNA, 151 bp, Homo Sapiens
  Brain
  sig_peptide 2..52: Von Heijne matrix
  score 3.90
  misc_feature 13..150: seq PLAGLAAAALGRA/PP; blastn; identity 100; region 1..138
  id T36282
  misc_feature 46..150: est; blastn; identity 99; region 1..105
  id T08090
  misc_feature 46..150: est; blastn; identity 99; region 1..105
  id T08091
  misc_feature 72..150: est; blastn; identity 98; region 1..79
  id H56620
  misc_feature 80..150: est; blastn; identity 100; region 1..71; id AA027983; est
aatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaag

SEQ ID NO: 256 - DNA, 217 bp, Homo Sapiens
  Brain
  sig_peptide 59..109: Von Heijne matrix
  score 3.80
  misc_feature 3..214: seq GFVAALVAGGVAG/VS; blastn; identity 99; region 14..225
  id H08058
  misc_feature 2..91: est; blastn; identity 100; region 10..99; id R11727; est
agacgtgatccgcttctgctccggcttggattgtagccttgacgaggtctgagcgaccatggaccggccggggttcgtggcagcgctggtggctggtggggtagcaggtgtttctgttgacttgatattatttcctctggataccattaaaaccaggctgcagagtccccaaggatttagtaaggctggtggttttcatggaatatatgctagctgg

SEQ ID NO: 257 - DNA, 158 bp, Homo Sapiens
  Brain
  sig_peptide 9..71: Von Heijne matrix
  score 3.80
  misc_feature 39..155: seq SMDLLTLLFQRRS/HQ; blastn; identity 98; region 1..117; id C01598; est
aatcaagtatgattgtttggtttgagggtatttccatggatctccttacactgctattccagaggagaagccaccaggtcactcaactcttagtatcatctactggaaactggctaagacagtatttatgtgcttctctcacaatagcaggaagaagg

SEQ ID NO: 258 - DNA, 292 bp, Homo Sapiens
  Brain
  sig_peptide 143..202: Von Heijne matrix
  score 3.80
  misc_feature complement(192..269): seq ALDALMFPARRRA/AV; blastn; identity 92; region 354..431
  id N70088
  misc_feature complement(222..262): est; blastn; identity 95; region 399..439; id H30254; est
aagcggctgtcctccctcgcttttggagctccgacctcagcttcgcctgcgagctgggttgtgtaaaggctggtcattttggggcgcttaggggtgggtgccggggggcgcgctttccctcgtgaaggtcgctccaggagtcatgcgtacattcgttcattttgctctggacgcactgatgttcccggctcgccgccgtgccgcagtcacgaggctctccgaacgcctttcactgtgtttctgtttacattcgcgtctgcaagacccggcggcgcgaccgaggccctcttgg

SEQ ID NO: 259 - DNA, 338 bp, Homo Sapiens
  Brain
  sig_peptide 42..224: Von Heijne matrix
  score 3.80
  misc_feature 131..273: seq LVMTFLFRNGSLQ/EK; blastn; identity 92; region 120..262
  id R10063
  misc_feature 35..101: est; blastn; identity 100; region 26..92
  id R10063
  misc_feature 103..149: est; blastn; identity 100; region 93..139
  id R10063
  misc_feature 275..312: est; blastn; identity 97; region 266..303
  id R10063
  misc_feature 131..273: est; blastn; identity 92; region 130..272
  id R12045
  misc_feature 35..100: est; blastn; identity 100; region 36..101
  id R12045
  misc_feature 103..149: est; blastn; identity 100; region 103..149
  id R12045
  misc_feature 3..35: est; blastn; identity 96; region 5..37
  id R12045
  misc_feature 131..273: est; blastn; identity 92; region 125..267
  id R12117
  misc_feature 5..100: est; blastn; identity 98; region 1..96
  id R12117
  misc_feature 103..149: est; blastn; identity 100; region 98..144
  id R12117
  misc_feature 131..273: est; blastn; identity 92; region 102..244
  id T79499
  misc_feature 28..102: est; blastn; identity 93; region 1..75
  id T79499
  misc_feature 104..149: est; blastn; identity 97; region 76..121
  id T79499
  misc_feature 275..312: est; blastn; identity 97; region 248..285
  id T79499
  misc_feature 109..178: est; blastn; identity 95; region 109..178
  id H17371
  misc_feature 275..332: est; blastn; identity 100; region 283..340
  id H17371
  misc_feature 44..106: est; blastn; identity 95; region 42..104; id H17371; est
agcttacagttcctaaccccgaccctgcgcgcasccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagcctccaggagaagctgtgggccatactgcaggccacatatatccactcctggaacctggcacggtttgtgttcacctacaagggtctccgtgccctgcagtcctacatacaaggccctggg

SEQ ID NO: 260 - DNA, 364 bp, Homo Sapiens
  Brain
  sig_peptide 128..181: Von Heijne matrix
  score 3.80
  misc_feature 44..158: seq GXALGLLPSLAKA/ED; blastn; identity 99; region 208..322
  id AA017601
  misc_feature 287..334: est; blastn; identity 97; region 451..498
  id AA017601
  unsure -12: est
  position -12 of amino acid sequence
  unsure 43: Xaa = His,Gln; position 43 of amino acid sequence; Xaa = Leu,Gln,Arg
acccagctcccggaagtgcgcccggagccggcgccgcgggccgagtgtcctggtgaagacctagttcttgccggagacaattccactgcagaagcactttacttaaaaggacttgccaggctggacaatgcccgttgacttggggcadgccctaggcctgctgccatcgctggcgaaggccgaggactcccagttctcagaatcagatgctgcccttcaagaggaactctccagccctgagaccgcacgccagcttttcaggcagttccgttaccaggtgatgtctgggcctcatgagaccttgaagcdacttcggaagctctgtttccagtggctacagccagaggttcacaccaaagagggg

SEQ ID NO: 261 - DNA, 433 bp, Homo Sapiens
  Brain
  sig_peptide 17..232: Von Heijne matrix
  score 3.80
  misc_feature complement(324..433): seq LMGLALAVYKCQS/MG; blastn; identity 100; region 253..362
  id H93008
  misc_feature complement(200..267): est; blastn; identity 92; region 423..490
  id H93008
  misc_feature complement(159..205): est; blastn; identity 93; region 484..530
  id H93008
  misc_feature complement(116..162): est; blastn; identity 91; region 526..572
  id H93008
  misc_feature complement(259..299): est; blastn; identity 97; region 390..430
  id H93008
  misc_feature complement(52..83): est; blastn; identity 90; region 602..633
  id H93008
  misc_feature 67..243: est; blastn; identity 100; region 1..177
  id AA146840
  misc_feature 332..417: est; blastn; identity 100; region 269..354
  id AA146840
  misc_feature 242..299: est; blastn; identity 100; region 177..234
  id AA146840
  misc_feature 299..334: est; blastn; identity 100; region 235..270
  id AA146840
  misc_feature 85..299: est; blastn; identity 99; region 1..215
  id AA036893
  misc_feature 299..412: est; blastn; identity 97; region 216..329
  id AA036893
  misc_feature 98..243: est; blastn; identity 98; region 1..146
  id T49176
  misc_feature 242..299: est; blastn; identity 100; region 146..203
  id T49176
  misc_feature 344..396: est; blastn; identity 98; region 250..302
  id T49176
  misc_feature 299..349: est; blastn; identity 96; region 204..254
  id T49176
  misc_feature 19..243: est; blastn; identity 100; region 1..225
  id H01262
  misc_feature 242..296: est; blastn; identity 100; region 225..279; id H01262; est
actcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagtcagtggtggaggactgcttttgtgaacatgagaaagcagcgcctggtccctatgtatttgggtcttatttacatccttctttaagcccagtggctcctcagcatactcttaaactaatcacttatgttaaaaag

SEQ ID NO: 262 - DNA, 370 bp, Homo Sapiens
  Brain
  sig_peptide 65..217: Von Heijne matrix
  score 3.80
  misc_feature 2..250: seq NVLFVAGLAFVIG/LE; blastn; identity 99; region 14..262
  id N33874
  misc_feature 78..270: est; blastn; identity 98; region 1..193
  id H01141
  misc_feature 283..349: est; blastn; identity 97; region 207..273
  id H01141
  misc_feature 284..366: est; blastn; identity 92; region 320..402
  id AA023741
  misc_feature 74..270: est; blastn; identity 100; region 2..198
  id R27699
  misc_feature 320..349: est; blastn; identity 93; region 253..282
  id R27699
  misc_feature complement(320..366): est; blastn; identity 97; region 282..328
  id N33481
  misc_feature complement(283..322): est; blastn; identity 100; region 327..366
  id N33481
  misc_feature complement(235..270): est; blastn; identity 97; region 379..414; id N33481; est
acgactcagcttcccaccctgggctttccgaggtgctttcgccgctgtccccaccactgcagccatgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaagaacattcagattcttcttccaaaaacataaaatgaaagctacaggtttttttctgggtggtgtatttgtagtccttattggttggcctttgataggcatgatcttcgaaatttatggattttttctcttgttcaggggcttaggg

SEQ ID NO: 263 - DNA, 249 bp, Homo Sapiens
  Brain
  sig_peptide 91..189: Von Heijne matrix
  score 3.60
  misc_feature 112..249: seq LAVFQMLKSMCAG/QR; blastn; identity 97; region 153..290
  id AA010288
  misc_feature 112..218: est; blastn; identity 96; region 101..207
  id R26319
  misc_feature 208..247: est; blastn; identity 92; region 198..237
  id R26319
  misc_feature 110..249: est; blastn; identity 95; region 24..163
  id W69087
  misc_feature 112..247: est; blastn; identity 98; region 103..238
  id H01791
  misc_feature complement(112..217): est; blastn; identity 98; region 287..392
  id AA146617
  unsure -17: est; position -17 of amino acid sequence; Xaa = Ser,Thr
aaaaaagcgaaggccggccgggcggggaagggaaatggcgaggcaggagtgcgggggagggagtggtccttagctgaatgcgcctgcgttatggcggcctccggcgccccaaggatcctggtggacctgctgaagctgascgtggcccccctcgccgtcttccagatgctcaagtccatgtgtgccgggcagaggctagcgagcgagccccaggaccctgcggccgtgtctctgcccacgtcgagcggg

SEQ ID NO: 264 - DNA, 324 bp, Homo Sapiens
  Brain
  sig_peptide 49..126: Von Heijne matrix
  score 3.60
  misc_feature 52..178: seq ARSLLQFLRLVGQ/LK; blastn; identity 98; region 68..194
  id W51974
  misc_feature 173..253: est; blastn; identity 98; region 190..270; id W51974; est
aaggagcttcgccgcggcctgctccgcccagccggggtcggtggccgcatggcttcggtctcctctgcgaccttctcgggccacggggctcggtccctactgcagttcctgcggctggtagggcagctcaagagagtcccacgaactggctgggtatacagaaatgtccagaggccggagagcgtttcagatcacatgtaccggatggcagttatggctatggtgatcaaagatgaccgtcttaacaaagaccgatgtgtacgcctagccctggttcatgatatggcagaatgcatcgttggggacatagcaccagcagatggg

SEQ ID NO: 265 - DNA, 157 bp, Homo Sapiens
  Brain
  sig_peptide 86..133: Von Heijne matrix
  score 3.60
  misc_feature complement(2..156): seq LAVLLVLFTLNIL/KS; blastn; identity 96; region 72..226
  id AA134487
  misc_feature complement(43..156): est; blastn; identity 98; region 73..186
  id T23528
  misc_feature complement(6..156): est; blastn; identity 96; region 69..219; id R50519; est
actgtataatrtgtgtatatkaaaatgtaattgatttcagyygaaagtattttaaagctgataaatagcattagggttctttgcaatgtggtatctagctgtattattggttttatttactttaaacattttgaaaagcttatactggcagcctggg

SEQ ID NO: 266 - DNA, 370 bp, Homo Sapiens
  Brain
  sig_peptide 197..322: Von Heijne matrix
  score 3.50
  misc_feature 41..79: seq INSLLEXSSLSRC/LE; blastn; identity 92; region 80..118
  id T06923
  unsure -7: est; position -7 of amino acid sequence; Xaa = Ala,Thr
acataaaggacasacgagtcctaattgacaacatctagtctttctggatgttaaagaggttgccagtgtatgacaaaagtagagttagtaaactaatatattttgtacattttgttttacaagtcctaggaaagattgtcttctgaaaatttgatgtcttctgggttgawggagatgggaagggttctaggccagaatgttcacatttggaagactctttcaaattataactgttgttacatgtttgcagtttattcaagactgctgtatacatagtagacaaattaactccttacttgarrcatctagtctatctagatgtttagaagtgccgatgtatgtyaaatgtataggtagtaaaataccactt

SEQ ID NO: 267 - DNA, 301 bp, Homo Sapiens
  Brain
  sig_peptide 116..268: Von Heijne matrix
  score 3.50
  misc_feature 53..297: seq VGTLCQLDWWIWG/GI; blastn; identity 96; region 31..275
  id HUM414A03B
  misc_feature 22..51: est; blastn; identity 100; region 1..30
  id HUM414A03B
  misc_feature 106..256: est; blastn; identity 99; region 84..234
  id H83476
  misc_feature 48..105: est; blastn; identity 96; region 27..84; id H83476; est
aaaatcaaggcaggggatggaggcaagtgggggtcgcgcctggagcggagcrtcggcctccggagccgcagctgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcctgg

SEQ ID NO: 268 - DNA, 404 bp, Homo Sapiens
  Brain
  sig_peptide 261..353: Von Heijne matrix
  score 11.30
  misc_feature 261..404: seq LLLCLLWIGYSQG/TT; blastn; identity 100; region 1..144; id HSU16126; vrt
aggatttctcccggatgctctccgactaacatggatgtcccaccattccttgcagtggaaggttgttccttggcgcagtgagtgaagaacatgcagcgattgctaatgggtttgggaagcggagactccttcctctctctatgaccatgccgtgatcgtgtctgcggtcaccactcgacgcatcctcatttctacccgaacccaggagccgaacgctagatcggggaagtgggtgccgtgcgtgtgggcacagaaacaccatgaagattattttcccgattctaagtaatccagtcttcaggcgcaccgttaaactcctgctctgtttactgtggattggatattctcaaggaaccacacatgtattaagatttggtggtatttttgaatatgtggaatctggc

SEQ ID NO: 269 - DNA, 249 bp, Homo Sapiens
  Brain
  sig_peptide 79..156: Von Heijne matrix
  score 6.60
  misc_feature 52..250: seq LFWLASGWTPAFA/YS; blastn; identity 99; region 2..200
  id HS7B2
  misc_feature 14..250: vrt; blastn; identity 98; region 24..260
  id R14271
  misc_feature 14..250: est; blastn; identity 98; region 25..261
  id R18347
  misc_feature 14..233: est; blastn; identity 97; region 43..262
  id H10233
  misc_feature 14..240: est; blastn; identity 99; region 44..270
  id HSC0IE021
  misc_feature 42..250: est; blastn; identity 98; region 1..209
  id HSCZSC021
  est
  misc_feature 13: n=a, g, c or t
aagttcgcccgtntcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgg

SEQ ID NO: 270 - DNA, 316 bp, Homo Sapiens
  Brain
  sig_peptide 179..250: Von Heijne matrix
  score 4.80
  misc_feature 212..311: seq ATMVSGSSGLAXA/RL; blastn; identity 93; region 1..101
  id HSSCOASN
  misc_feature 243..311: vrt; blastn; identity 94; region 60..128
  id AA135265
  misc_feature 187..245: est; blastn; identity 91; region 5..63
  id AA135265
  misc_feature 269..311: est; blastn; identity 100; region 49..91
  id R58602
  est
  misc_feature 246: n=a, g, c or t
  unsure -2: position -2 of amino acid sequence
  unsure 6: Xaa = Ala,Asp,Gly,Val; position 6 of amino acid sequence; Xaa = Ser,Thr
agagttattatctgcststccgataggatgcctctttgtcttcacctgccattcccgctgtttcgtgaagaatcctctgtaaagggaaatttgttcaggcgactgctgtggccaccctctgcctcctccggcctctgcccctgggaggtccccgggggcctgggagtgtcattggcgtatgaccgcaacccttgccgctgccgctgacatcgctaccatggtctccggcagcagcggcctcgccgncgcccgtctcctgtcgcgcasttcctcctgccgcagaatggaattcggcattgttcctacacagccacgg

SEQ ID NO: 271 - DNA, 231 bp, Homo Sapiens
  Liver
  sig_peptide 25..129: Von Heijne matrix; score 15.00; seq LFLLLLLAASAWG/VT
aagaagcaaaagagcagagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccacg

SEQ ID NO: 272 - DNA, 384 bp, Homo Sapiens
  Hypertrophic prostate
  sig_peptide 97..159: Von Heijne matrix
  score 13.20
  seq LLLXAVLLSLASA/SS
  misc_feature 305: n=a, g, c or t
  unsure -10: position -10 of amino acid sequence
  unsure 49: Xaa = Cys,Tyr; position 49 of amino acid sequence; Xaa = Cys,Phe,Ser,Tyr
akgaagagcagcggcgaggcggcggtggtggctgadtccgtggtggcagaggcgaaggcgacagctctaggggttggcaccggccccgagaggaggatgcgggtccggatagggctgacgctgctgctgtrtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatnctctattcaagaagaggaagacagcctcaagagccaagagggggaaagtgtcacagaagatatcagctttctagagtct

SEQ ID NO: 273 - DNA, 438 bp, Homo Sapiens
  Substantia nigra
  sig_peptide 64..126: Von Heijne matrix
  score 13.10
  unsure 5: seq CVLLLLLLLLTRS/SE
  position 5 of amino acid sequence
  unsure 6: Xaa =  * ,Tyr; position 6 of amino acid sequence; Xaa = Lys,Arg
aattttggagagttaaaactgtgcctaacagaggtgtcctctgacttttcttctgcaagctccatgttttcacatcttccctttgactgtgtcctgctgctgctgctgctactacttacaaggtcctcagaagtggaatamaragcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctg

SEQ ID NO: 274 - DNA, 145 bp, Homo Sapiens
  kidney
  sig_peptide 59..121: Von Heijne matrix; score 11.60; seq LLFLFLAVDEAWA/GM
aacactaccttcccgaagttgaaggcaagcggtgattgtttgtagacggcgctttgtcatgggacctgtgcggttgggaatattgcttttcctttttttggccgtggacgaggcttgggctgggatgttgaaggaggagggacgg

SEQ ID NO: 275 - DNA, 258 bp, Homo Sapiens
  Kidney
  sig_peptide 25..75: Von Heijne matrix
  score 10.70
  misc_feature 58..194: seq SLLLAVALGLATA/VS; blastn; identity 100; region 44..180; id AA280744; est
aatggctgaggaggtcgcagcgccatgaagtccctgtctctgctcctcgctgtggctttgggcctggcgaccgccgtctcagcaggacccgcggtgatcgagtgttggttcgtggaggatgcgagcggaaagggcctggccaagagacccggtgcactgctgttgcgccagggaccgggggaaccgccgccccggccggacctcgaccctgagctctatctcagtgtacacgaccccgcgggcgccctccaggctcgg

SEQ ID NO: 276 - DNA, 458 bp, Homo Sapiens
  Hypertrophic prostate
  sig_peptide 144..191: Von Heijne matrix
  score 9.60
  seq LLTLXLLGGPTWA/GK
  misc_feature 166: n=a, g, c or t
  unsure -9: position -9 of amino acid sequence
  unsure 53: Xaa = Ala,Asp,Glu,Gly,Val
  position 53 of amino acid sequence
  unsure 60: Xaa = Gly,Ser
  position 60 of amino acid sequence
  unsure 61: Xaa = Arg,Ser,Thr; position 61 of amino acid sequence; Xaa = Leu,Val
gttcccctggcggcccctcgcttcttccttctggatgggggcccagggggcccaggagagtataaaggcgatgtggagggtgcccggcacaaccagacgcccagtcacaggcgagagcctgggatggcacccggccagaggccatgctgctgctgctcacgcttgnhctcctggggggccccacctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtgaaactgggagccttargtgggaatacccaggaagtcaswstgcagccaggcgaatacatcacaaaagtctttgtcgccttccaagctttcctccggggtatggtcatgtacaccagcaaggaccga

SEQ ID NO: 277 - DNA, 339 bp, Homo Sapiens
  Cancerous prostate
  sig_peptide 109..246: Von Heijne matrix
  score 9.40
  unsure -8: seq LIILIXIWIWCLG/SQ; position -8 of amino acid sequence; Xaa = Leu,Val
aattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattktgatttggatttggtgccttgggagtcagacatttgggacatcaacaaccaaatctgtacagttaaagatattaaggcagaacctcagccactttctccagcctcctcaagttatt

SEQ ID NO: 278 - DNA, 396 bp, Homo Sapiens
  Brain
  sig_peptide 115..204: Von Heijne matrix; score 9.40; seq LPFLLSLFPGALP/VQ
aagtatagattcggaaacagaaaacaaaagcaggaaaagtgaccttagcccggattctgccatccccggaaggcttattcctcctatgggcaaaggagcaaagggagccagaagatgaaagcgagctcagggaggtgcgggctggtgcggtggctgcaggtactgttgcccttcctgttgtctttgttccccggggctctcccagtccagatccgctattcaattccagaggagctggccaaaaactcggtcgtaggaaacctcgccaaggatctggggctcagcgtccgggacttgccagcccggaagctgcgggttagcgcggagaaggaatatttcacagtaaacccagaaagcggagacttacttgtgagtgacagaatagaccgagacgtg

SEQ ID NO: 279 - DNA, 419 bp, Homo Sapiens
  Normal prostate
  sig_peptide 258..356: Von Heijne matrix
  score 9.10
  seq IIFLCHLLRGLHA/XT
  misc_feature 237: n=a, g, c or t
  unsure 1: position 1 of amino acid sequence; Xaa = Ile,Leu
agttttcggtcggcccgggtgttctgcaagctggtcaaaaaggggaagcggcccagatatgttaagttctatggccgctgcagggtctgtgaaggcggcgttgcaggtggccgaggtgctggaagccatcgtgagctgctgcgtgggggcccgagggacggcaagttttgtgtacgaagcccactggcgaggtgcttctcagccggaatggaggccgcctcctggaggcgctacacnkagagcatcccatagccaggatgatagtggactgtgtttccagtcatctcaaaaaaacaggagatggtgcaaaaacatttattatctttctttgccatttgcttagaggacttcatgcdmtcacagacagagaaaaggatcctttgatgtgtgaaaacattcaaacccatggaaggcttccg

SEQ ID NO: 280 - DNA, 380 bp, Homo Sapiens
  Ovary
  sig_peptide 54..365: Von Heijne matrix
  score 9.10
  unsure -79: seq LTSLSWLLXASCS/KP
  position -79 of amino acid sequence
  unsure -27: Xaa = Cys,Phe,Tyr
  position -27 of amino acid sequence
  unsure -5: Xaa = Ala,Ser
  position -5 of amino acid sequence
  unsure 3: Xaa = Pro,Thr; position 3 of amino acid sequence; Xaa =  * ,Cys
aattgcgcgccggcctcaagatggccgccttctggcgtctccggcgctgttgaatggcgaaagctttattgttcccttcgggcaggagtgttcgtgtcctctatggcgctgtcaataaagaacggcagtdtgaatcggtgctgaacagggcctgtcctcccaaagccaactctaaggagaggagaggaagagcagttcttggggcagagttgacgcaatggagctccccaactacagccggcagctgctgcagcagctgtacactctgtgcaaggagcagcagtkctgtgattgcaccatctccattggtaccatttacttcagggctcacaagcttgtcctggctgctgmcagcmtcctgttcaaaaccctgmaaaggg

SEQ ID NO: 281 - DNA, 428 bp, Homo Sapiens
  Brain
  sig_peptide 27..245: Von Heijne matrix
  score 8.00
  seq LATKLLSLSGVFA/VH
  misc_feature 342,360: n=a, g, c or t
  unsure 33: position 33 of amino acid sequence
  unsure 39: Xaa =  * ,Glu,Lys,Gln
  position 39 of amino acid sequence
  unsure 51: Xaa =  * ,Ala,Asp,Glu,Phe,His,Ile,Lys,Leu,Asn,Pro,Gln,Ser,Thr,Val,Tyr; position 51 of amino acid sequence; Xaa = Ser,Thr
aagaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcagaagctggaatgccttctccagaatggacanagaggaaaaagcagacknhwgaaaattgggcatggagggactctagacagcgcasccgaggagttctggttgttggaattggagcg

SEQ ID NO: 282 - DNA, 332 bp, Homo Sapiens
  kidney
  sig_peptide 201..251: Von Heijne matrix
  score 7.80
  seq VLWLISFFTFTDG/HG
  misc_feature 97: n=a, g, c or t
aattgctgatggatcagtgagcctgtgttcatgccagtgagctgctgtggctcagatactgatactttctttccaaacagcataagaagtgattganccacaagtatactgaaggmarggyhcccwsvartyctggwgtgamgagataaatcaccagtcacagactatgcacccgactgctgctgttcagtccagggaaaatgaaagttggagtgctgtggctcatttctttcttcaccttcactgacggccacggtggcttcctgggggtgagttggtgctatgtctcatatctcttctcaactaactctcctctctcgttccggcgcatg

SEQ ID NO: 283 - DNA, 437 bp, Homo Sapiens
  Surrenals
  sig_peptide 81..137: Von Heijne matrix
  score 7.40
  seq WIFLAAILKGVQC/EV
  misc_feature 291: n=a, g, c or t
  unsure 52: position 52 of amino acid sequence
  unsure 90: Xaa =  * ,Gly,Arg; position 90 of amino acid sequence; Xaa = Pro,Thr
agctctgggagaggagccccagccttgggattcccaagtgttttcattcagtgagcaggactgaacacagaggactcaccatggagtttgggctragctggattttccttgcagctattttaaaaggtgtccagtgtgaggtgcagctggtggagtctgggggaggcttggtaaagcctggggggtccctgagactctcctgtgcagcctctggattcgatttcactgacgcctggatgagttgggtccgccaggctccggggaaggggctggagtgggttgccaatatangaagcacagcctctggtgggacaagaggctacgctgcacccgtgaaagacagattcatcatctcaagggatgattcaagaaacactctacacctacaaatgaacggcctgaaamcgatgacacargccatctattattgtgccaca

SEQ ID NO: 284 - DNA, 466 bp, Homo Sapiens
  Cancerous prostate
  sig_peptide 17..127: Von Heijne matrix
  score 7.40
  seq LWRLLLWAGTAFQ/VX
  misc_feature 292..293,341..342: n=a, g, c or t
  unsure 2: position 2 of amino acid sequence
  unsure 5: Xaa = Ala,Asp,Asn,Thr
  position 5 of amino acid sequence
  unsure 6: Xaa = Pro,Arg,Thr
  position 6 of amino acid sequence
  unsure 10: Xaa = Glu,Gly
  position 10 of amino acid sequence
  unsure 39: Xaa = His,Gln
  position 39 of amino acid sequence
  unsure 55: Xaa = Pro,Ser
  position 55 of amino acid sequence
  unsure 56: Xaa =  * ,Cys,Ser,Trp
  position 56 of amino acid sequence
  unsure 72: Xaa = Phe,Ile,Leu,Val; position 72 of amino acid sequence; Xaa =  * ,Ala,Glu,Gly,Lys,Leu,Met,Pro,Gln,Arg,Ser,Thr,Val,Trp
aactcaggacaacgctatggctgagcctgggcacagccaccatctctccgccagagtcaggggaagaactgagaggcgcataccccggctgtggcggctgctgctctgggctgggaccgccttccaggtgrmccagggamsggraccggagcttcasgcctgcaaagagtctgagtaccactatgagtacacggcgtgtgacagcacgggttccaggtggagggtcgccgtgccgcatachycgggcctgtgcaccagcctgcctgaccccgtcaagggcaccgagtgctsnntctcctgcaacgccggggagtttctggatatgaaggaccagtcatgtnngccatgcgctgagggccgctactccctcggcacaggcattcggtttgatgagtgggatgagctgccccatggctttgcagcctctcagccaacatggagctggatgacagtgctgctgagtcac

SEQ ID NO: 285 - DNA, 318 bp, Homo Sapiens
  Umbilical cord
  sig_peptide 4..78: Von Heijne matrix
  score 7.10
  unsure 5: seq QACLLGLFALILS/GK; position 5 of amino acid sequence; Xaa = Asp,His,Tyr
aacatgacagcagatccgcggaagggcagaatgggactccaagcctgcctcctagggctctttgccctcatcctctctggcaaatgcagtbacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgaccctagagaatgtggctgatctggtgaggccatccccactgaccccg

SEQ ID NO: 286 - DNA, 329 bp, Homo Sapiens
  Normal prostate
  sig_peptide 69..140: Von Heijne matrix
  score 6.90
  unsure 17: seq LCFLLLAVAMSFF/GS
  position 17 of amino acid sequence
  unsure 43: Xaa = Asp,Glu; position 43 of amino acid sequence; Xaa = Lys,Asn
aagtttctggagctgttccgagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagadaagatgatgcggctgggggggcggctggtgctgaacaccaaggaggagctggccaatgagaggctcatgacgctcaawatcgctgagatgaaggaggccatgaggaccctgatattcccacccagcatgcactttttc

SEQ ID NO: 287 - DNA, 392 bp, Homo Sapiens
  Brain
  sig_peptide 9..59: Von Heijne matrix; score 6.80; seq LVLVLVVAVTVRA/AL
aagttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactgactgctattgccctgtattttgcaatccaggacttcaataaagttgtgtttaaaaagcagaaactcctcctagaactggaccagtatgccccagatgtggccgaactcatccgg

SEQ ID NO: 288 - DNA, 418 bp, Homo Sapiens
  Substantia nigra
  sig_peptide 23..328: Von Heijne matrix
  score 6.70
  seq LXMTLMLPFKILS/DS
  misc_feature 295: n=a, g, c or t
  unsure -12: position -12 of amino acid sequence; Xaa = Ile,Met
agctcatttgtaggctgaactaatgactgccgccataagaagacagagagaactgagtatcctcccaaaggtgacactggaagcaatgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgatnatgacactcatgcttcctttcaaaatcctctctgactcacacctggcaccctggcagctcagagcttttgtgtgtcgtttttcttcggtgatattttatgagaccatgtatgtgggcgagggg

SEQ ID NO: 289 - DNA, 379 bp, Homo Sapiens
  Spleen
  sig_peptide 203..340: Von Heijne matrix; score 6.30; seq SIGVLTLSHLISG/LR
actttttcggagggtggtgagctagtaagtgtggttttagctgtagtagccagattgggcggccgggagtggtgggggtgccgggtggaaggctctgggcggggtctcaggaccctccttttcttggcggggatcgggcttgtggtgccgctccccgtaatgtacggaggaagagggaaagggctctggccccctcggcgtcatgtcttcggtgctggcggcttcccatccgctggttctatcctcaaacgccgggacaccgggaatctcggagaaggacaaccgagatccagctggctcctccatcggggtgctcacactttctcatttgatttcaggtctgcggacgctgtataccctcctccacttcccgctgcgg

SEQ ID NO: 290 - DNA, 369 bp, Homo Sapiens
  Thyroid
  sig_peptide 55..204: Von Heijne matrix
  score 6.30
  unsure 22: seq LIILGLVLFMVYG/NV; position 22 of amino acid sequence; Xaa = Ile,Ser
agmgcaggcctggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggmaacgtgcacgtgagcacagagtccaacctgcaggccaccgagcgccgagccgagggcctatacakycagctcctagggctcacggcctcccagtccaacttgaccaaggagctcaacttcaccacccgcgccaaggatgccatcatgcagatgtggctgaatgct

SEQ ID NO: 291 - DNA, 402 bp, Homo Sapiens
  Cancerous prostate
  sig_peptide 205..396: Von Heijne matrix; score 6.30; seq SCLVSGWGLLANG/QR
aaaaacggcgaggactgcagcccgcactcgcagccctggcaggcggcactggtcatggaaaacgaattgttctgctcgggcgtcctggtgcatccgcagtgggtgctgtcagccgcacactgtttccagaagtgagtkcagagctcctacaccatcgggctgggcctgcacagtcttgaggccgaccaagagccagggagccagatggtggaggccagcctctccgtacggcacccagagtacaacagacccttgctcgctaacgacctcatgctcatcaagttggacgaatccgtgtccgagtctgacaccatccggagcatcagcattgcttcgcagtgccctaccgcggggaactcttgcctcgtttctggctggggtctgctggcgaacggccagcgg

SEQ ID NO: 292 - DNA, 445 bp, Homo Sapiens
  Cancerous prostate
  sig_peptide 20..160: Von Heijne matrix
  score 6.30
  seq VICCVLFLLFILG/YI
  misc_feature 398: n=a, g, c or t
  unsure 80: position 80 of amino acid sequence
  unsure 81: Xaa =  * ,Cys,Asp,Glu,Phe,Gly,His,Ile,Lys,Leu,Met,Asn,Gln,Arg,Ser,Val,Trp,Tyr; position 81 of amino acid sequence; Xaa = Glu,Gly
acactccggagactgagccatggggggaaagcagcgggacgaggatgacgaggcctacgggaagccagtcaaatacgacccctcctttcgaggccccatcaagaacagaagctgcacagatgtcatctgctgcgtcctcttcctgctcttcattctaggttacatcgtggtggggattgtggcctggttgtatggagacccccggcaagtcctctaccccaggaactctactggggcctactgtggcatgggggagaacaaagataagccgtatctcctgtacttcaacatcttcagctgcatcctgtccagcaacatcatctcagttgctgagaacggcctacagtgccccacaccccaggtgtgtgtgtcctcctgcccggaggacccatggactndbgraaaaacgagttctcacagactgttggggaagtcttctatacaa

SEQ ID NO: 293 - DNA, 382 bp, Homo Sapiens
  Hypertrophic prostate
  sig_peptide 23..76: Von Heijne matrix; score 6.30; seq VLLFLAWVCFLFY/AG
aacttccgggtgccattgcaggatgcagaaagcctcagtgttgctcttcctggcctgggtctgcttcctcttctacgctggcattgccctcttcaccagtggcttcctgctcacccgtttggarctcaccaaccatagcagctgccaagagcccccaggccctgggtccctgccatgggggagccaagggaaacctggggcctgctggatggcttcccgattttcgcgggttgtgttggtgctgatagatgctctgcgatttgacttcgcccagccccagcattcacacgtgcctagagagcctcctgtctccctacccttcctgggcaaactaagctccttgcagaggatcctggagattcagccccaccatgcccggctc

SEQ ID NO: 294 - DNA, 402 bp, Homo Sapiens
  Lung
  sig_peptide 133..375: Von Heijne matrix
  score 5.70
  unsure -5: seq CWMMLLGSXGSFL/AP
  position -5 of amino acid sequence
  unsure 6: Xaa = Ala,Pro; position 6 of amino acid sequence; Xaa = Cys,Ser
aaaaacgcgcgcsacgattcgaggtgctctgtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcctctggacacactcggaggaaactgcaagggaaactgccagagctgcagggcgtcgagactgaactgtgctacaacgtgaactggacagctgaggccctccccagtgctgaggagacaaagaagctgatgtggctgtttggttgcccttactgctggatgatgttgctcgggagtsctggctccttcctggctccaatgacctgcwgctggaggtcg

SEQ ID NO: 295 - DNA, 347 bp, Homo Sapiens
  Brain
  sig_peptide 114..221: Von Heijne matrix; score 5.60; seq ILRLLGSLSNAYS/PR
ggaasyysgacgcatgcgccgtttctctgcatggtgtgcgttctcgttctagctgcggccgcagagctgtggcggttttcctaatcctgcgaatatgggtagtgcwtcgttccatggacgtwacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccctagtaacatgtataccaaatactacattcaccgaaatggg

SEQ ID NO: 296 - DNA, 451 bp, Homo Sapiens
  kidney
  sig_peptide 278..340: Von Heijne matrix
  score 5.60
  unsure 27: seq LLRVLNLPHNSIG/CV; position 27 of amino acid sequence; Xaa = Ile,Val
atacaagctccacagagccgcgggaggacggttgcctggtattattagcaagcagcaaatatggcggtggcgcgcgtggacgcggctttgcctcccggagaaggatcagtggtcaattggtcaggacarggrmywccagaaattaggtccaaatttaccctgtgaagctgatattcacactttgattctggataaaaatcagattattaaattggaaaatctggagaaatgcaaacgawkaatacagttatcagtagctaataatcggctggttcggatgatgggtgtggccaagctgacgttgcttcgtgtattaaatttgcctcataatagcattggctgtgtggaagggctaaaggaactagtacatctggaatggctgaatttggcaggaaataatcttaaggccatggaacagrtcaatagctgcacagctctacagcatctcgat

SEQ ID NO: 297 - DNA, 333 bp, Homo Sapiens
  Brain
  sig_peptide 139..246: Von Heijne matrix; score 5.60; seq ILRLLGSLSNAYS/PR
aactttgacagcggctggtccccggaagttgkkycgcatgcgccgtttctctgcatggtgtgcgttctcgttctagctgcggccgcagagctgtggcggttttcctaatcctgcgaatatggggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccaataaaataaattcttttgaactagatcgagctgatagagaccgg

SEQ ID NO: 298 - DNA, 175 bp, Homo Sapiens
  Colon
  sig_peptide 83..121: Von Heijne matrix; score 5.50; seq MVLLTMIARVADG/LP
aataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggaagtgaggacggcgccaagggcattg

SEQ ID NO: 299 - DNA, 410 bp, Homo Sapiens
  Cancerous prostate
  sig_peptide 144..284: Von Heijne matrix
  score 5.30
  seq GCGMFTFLSSVXA/AV
  misc_feature 280,363: n=a, g, c or t
  unsure -23: position -23 of amino acid sequence
  unsure -2: Xaa = Ile,Ser
  position -2 of amino acid sequence
  unsure 27: Xaa = Ile,Asn,Ser,Thr; position 27 of amino acid sequence; Xaa = Leu,Met,Val
acacaaatcacattagctttgcccgaagtttttccccacactcttctttagcatgctattatggggaaagtgaccactcctgggagcgggggtggtcggggcggtttggtggcggggaagcggctgtaacttctamgkkraccatggtacctgttgaaaacaccgagggccccagtctgctgaaccagaaggggacagccgtggagacggagggcakcggcagccggcatcctccctgggcgagaggctgcggcatgtttaccttcctgtcatctgtcantgctgctgtcagtggcctcctggtgggttatgaacttgggatcatctctggggctcttcttcagatcaaaaccttattagccntgagctgccatgagcaggaaatggttgtgagctccctcgtcattgga

SEQ ID NO: 300 - DNA, 377 bp, Homo Sapiens
  Cancerous prostate
  sig_peptide 237..308: Von Heijne matrix
  score 5.20
  seq LLFPVGRSWSCFA/QT
  misc_feature 317: n=a, g, c or t
  unsure 3: position 3 of amino acid sequence; Xaa = Leu,Pro,Arg
acctgtcttgaggtctaatggcggacgccagtatgttggagttggtggtggcttaagttttgaagggaggtagcatccgttggatatccacaccatccttctcgctgcaggctttcttggactccgtactgttggtgtaaccaaggcctggaggtctgggtggctcaggtttcctgcagccatgtttctgtacaacttaaccttgcagagagccactggcatcagctttgccattcatggaaacttttctggaaccaaacaacaagaaattgttgtttcccgtgggaagatcttggagctgcttcgcccagacccbntcactggcaaagtacataccctactcactgtggaagtattcggtgttatccggtcactca

SEQ ID NO: 301 - DNA, 360 bp, Homo Sapiens
  Normal prostate
  sig_peptide 31..75: Von Heijne matrix
  score 5.10
  seq FLWGLALPLFFFC/WE
  misc_feature 348,351,353: n=a, g, c or t
  unsure 84: position 84 of amino acid sequence
  unsure 91: Xaa =  * ,Ala,Asp,Glu,Phe,Leu,Ser,Val,Tyr
  position 91 of amino acid sequence
  unsure 92: Xaa = Arg,Ser
  position 92 of amino acid sequence
  unsure 93: Xaa =  * ,Asp,Glu,Lys,Asn,Tyr; position 93 of amino acid sequence; Xaa = Ile,Asn,Ser,Thr
agttctgtggagcagcggtggccggctaggatgggctttctctggggtctggctctgccccttttcttcttctgctgggaggttggggtctctgggagctctgcaggccccagcacccgcagagcagacactgcgatgacaacggacgacacagaagtgcccgctatgactctagcaccgggccacgccgctctggaaactcaaacactgagcgctgagacctcttctagggcctcaaccccagccggccccgttccagaagcagagaccaggggagccaagagaatttcccctgcaagagagaccaggagtttcacaaaaacrkhkcccaacttcatggtgctgagndanancgtcacg

SEQ ID NO: 302 - DNA, 339 bp, Homo Sapiens
  Spleen
  sig_peptide 106..168: Von Heijne matrix; score 4.90; seq WLLSDILGQGATA/NV
aaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaagagacaggg

SEQ ID NO: 303 - DNA, 236 bp, Homo Sapiens
  Lymphocytes
  sig_peptide 120..167: Von Heijne matrix; score 4.90; seq ICAGSVLPPYSNC/QM
aaaccctggtgttcctgacacaaacttcaggaaaggattttgcacttgtgcagaccgggcgagcagagtaagaagcaggtacgtgggtttttccaagttctgtgtttcagtcctgttggatggttgagatctgtgcagggtctgtgcttccgccttattcaaactgtcagatgccagaaccttcgatctttactttgatacatttccacacttattactgcctcacaaccccacag

SEQ ID NO: 304 - DNA, 255 bp, Homo Sapiens
  Brain
  sig_peptide 37..165: Von Heijne matrix
  score 4.70
  unsure -19: seq LLAFGTSCSVVXY/XP
  position -19 of amino acid sequence
  unsure -2: Xaa = Cys,Ser
  position -2 of amino acid sequence
  unsure 1: Xaa = Leu,Arg
  position 1 of amino acid sequence
  unsure 4: Xaa = Asp,Gly
  position 4 of amino acid sequence
  unsure 10: Xaa = Ile,Lys,Asn
  position 10 of amino acid sequence
  unsure 12: Xaa = Asn,Ser
  position 12 of amino acid sequence
  unsure 25: Xaa = His,Asn
  position 25 of amino acid sequence
  unsure 28: Xaa = Cys,Gly; position 28 of amino acid sequence; Xaa = Glu,Gly
agcgtctcttgtttgtgcggctgaccagttggcgacatggtggcacccgtgctggagacttctcacgtgttttgctgcccaaaccgggtgcggggmgtcctgaactggwgctctgggcccagaggacttctggcctttggcacgtcctgctccgtggtgckctatgrccccctgawmagggttgttgttaccarcttgmatggtcacaccgcccgagtcaattgcatacagtggattkgtaaacaggraggcatg

SEQ ID NO: 305 - DNA, 425 bp, Homo Sapiens
  Lymph ganglia
  sig_peptide 75..284: Von Heijne matrix
  score 4.70
  seq QLLLATLQEAATT/QE
  misc_feature 345..346: n=a, g, c or t
  unsure -54: position -54 of amino acid sequence
  unsure 21: Xaa = Gly,Arg; position 21 of amino acid sequence; Xaa = Ala,Cys,Asp,Phe,Gly,His,Ile,Leu,Asn,Pro,Arg,Ser,Thr,Val,Tyr
aagtgagaccgcgcggcaacagcttgcggctgcggggagctcccgtgggcgctccgctggctgtgcaggcggccatggattccttgcggaaaatgctgatctcagtcgcaatgctgggcgcargggctggcgtgggctacgcgctcctcgttatcgtgaccccgggagagcggcggaagcaggaaatgctaaaggagatgccactgcaggacccaaggagcagggaggaggcggccaggacccagcagctattgctggccactctgcaggaggcagcgaccacgcaggagaacgtggcctggaggaagaactggatggttggcggcgaaggcggcgccacggganntcaccgtgagaccggacttgcvtccgtgggcgccggaccttggcttgggcgcaggaatccgaggcagctttctccttcg

SEQ ID NO: 306 - DNA, 380 bp, Homo Sapiens
  Hypertrophic prostate
  sig_peptide 108..185: Von Heijne matrix; score 4.60; seq LLPFGMLCASSTT/KC
aactttcactttcgagagtgccgtctatttgccacacacttccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggag

SEQ ID NO: 307 - DNA, 406 bp, Homo Sapiens
  Cancerous prostate
  sig_peptide 5..334: Von Heijne matrix
  score 4.60
  unsure -19: seq HTXGLLGFGRXQG/SI
  position -19 of amino acid sequence
  unsure -11: Xaa = Asn,Ser
  position -11 of amino acid sequence
  unsure -3: Xaa = Phe,Leu
  position -3 of amino acid sequence
  unsure 10: Xaa = Ser,Thr
  position 10 of amino acid sequence
  unsure 15: Xaa = Glu,Lys
  position 15 of amino acid sequence
  unsure 18: Xaa = Lys,Thr; position 18 of amino acid sequence; Xaa = Glu,Gly
aactatggccgatgatctggagcagcagtctcaaggctggctgagtagctggctgcccacgtggcgccccacttccatgtctcagctgaagaatgtggaagccaggatcctccagtgtctccagaataagttcctggccagatatgtatccctcccaaaccagaataagatctggacggtgactgtgagccccgagcaaaacgaccgcacccccttggtgatggtgcatggttttgggggcggcgtgggtctctggatcctcaacatggactcactgartgcccgccgcacactgcacacctthggtctgcttggcttcgggcgaastcaaggcagcattcccaagggaccggaggggctkraggatgagtttgtgamatcratagrracatggcgggagacatgg

SEQ ID NO: 308 - DNA, 291 bp, Homo Sapiens
  Large intestine
  sig_peptide 94..165: Von Heijne matrix
  score 4.50
  unsure 35: seq PLSMILLSDKIQS/SK; position 35 of amino acid sequence; Xaa = Asp,Glu,Gly,His,Ile,Lys,Leu,Met,Asn,Gln,Arg,Ser,Val
atcatacgatgtactttttttaatgccgttgaaacagagttaatttcctttagcacacaagtcttagagacaaaagaaaaaaaggtctgcaacatgaaagtcacaggcatcacaatcctcttttggcccctctccatgatattattatcagacaaaatccagtcttctaaaagagaagtccaatgtaattttactgaaaaaaattataccttgattccagcagatatcaagaaagatgttactatacttgatctcagttataaccarvdbactcttaatggcacagacacg

SEQ ID NO: 309 - DNA, 327 bp, Homo Sapiens
  Brain
  sig_peptide 7..294: Von Heijne matrix; score 4.40; seq HLSWSSSAYQAWA/QE
agcatcatggcggctggccgggcccaggtcccttcctccgaacaagcctggcttgaggatgctcaggtcttcatccaaaagaccctgtgtccagctgtcaaggagcctaatgtccagttgactccattggtaattgattgtgtgaagactgtctggttgtcccagggaaggaaccaaggttctacactgcccctcagctatagcttcgtctcagtacaggacctcaagactcaccagcgtctcccatgctgcagccacctgtcgtggagcagtagtgcataccaggcctgggcccaagaggctggaccaaatgggaacccccctggg

SEQ ID NO: 310 - DNA, 311 bp, Homo Sapiens
  Normal prostate
  sig_peptide 186..227: Von Heijne matrix; score 4.00; seq STCCWCTPGGAST/ID
aacttccgctggtggcctagagcggggcccggtatggaggtgggctagaggccgacgccagccagagagcgaaatgttcttttggggccagagtctgggcatatatgaatgcaaatccgtgtttgttcacaactaagcccagctgagacgatcacttttctgtaggccatttgtccaggtatagaatgagcacatgttgttggtgtacgccaggtggtgcttccaccattgacttcctaaagcgctatgcttccaacactccgtccggtgaatttcaaacagccgacgaagacctctgctactgcttgggg

SEQ ID NO: 311 - DNA, 297 bp, Homo Sapiens
  Cancerous prostate
  sig_peptide 139..246: Von Heijne matrix
  score 3.90
  seq VVEILPYLPCLTA/RD
  misc_feature 28: n=a, g, c or t
  unsure -16: position -16 of amino acid sequence; Xaa = Asp,Asn,Tyr
actcctcgctgcgggaagggtcctgggncccgggcggcggtcgccaggtctcagggccgggggtacccgagtctcgtttcctctcagtccatccacccttcatggggccagagccctctctccagaatctgagcagcaatgccgtttgctgaagacaagacctataagtatatctgccgcaatttcagcaatttttgcdatgtggatgttgtagagattctgccttacctgccctgcctcacagcaagagaccaggatcgactgcgggccacctgcacactctcagggaaccgggcg

SEQ ID NO: 312 - DNA, 463 bp, Homo Sapiens
  Lymph ganglia
  sig_peptide 113..433: Von Heijne matrix
  score 3.90
  unsure -33: seq IVLVLLLGRYTEE/EQ
  position -33 of amino acid sequence
  unsure -26: Xaa = Asp,Glu
  position -26 of amino acid sequence
  unsure 9: Xaa = Gly,Ser; position 9 of amino acid sequence; Xaa = Lys,Arg
aaaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagctgttaccaagaactgtcaaaaagcatcccgggaatggcaggggagagaccttcttgttgtggacactccagggctctttgacaccaaggagagcctggabaccacctgcaaggaaatcrgccgctgcatcatctcctcctgcccagggccccatgctattgtcctagttctgctgctgggccgctacacagaggaggagcagaaaaccgttgcattgatcargctg

SEQ ID NO: 313 - DNA, 369 bp, Homo Sapiens
  Lung
  sig_peptide 73..219: Von Heijne matrix
  score 3.80
  unsure -11: seq LLXCVGNFFGSTQ/DA
  position -11 of amino acid sequence
  unsure -19: Xaa = Leu,Trp; position -19 of amino acid sequence; Xaa = Lys,Arg
aattttttccggggaacgcggattcgcattcccaattttaggtggcagtcgcaacccatactattcggacagatggcacagaaaccgctgcgcctcttggcttgtggagatgttgaaggaaagtttgatattttattcaatagagttcaagcaattcagaagarragtggaaactttgatctgctgtkgtgtgtaggaaatttctttggctccacccaagatgctgaatgggaggagtataagactggcatcaagaaagctcctattcagacatatgtgcttggtgctaataaccaggaaacagtaaaatatttccaggatgctgatggatgtgaattagctgaaaacattacttatctggggcgaggg

SEQ ID NO: 314 - DNA, 383 bp, Homo Sapiens
  Hypertrophic prostate
  sig_peptide 57..212: Von Heijne matrix
  score 3.80
  seq RPVLLHLHQTAHA/DE
  misc_feature 340: n=a, g, c or t
  unsure 31: position 31 of amino acid sequence
  unsure 43: Xaa = Ser,Thr; position 43 of amino acid sequence; Xaa = Ile,Asn,Ser,Thr
acggtcaagctaaggcgaagagtgggtggctgaagccatactattttatagaattaatggaaagcagaaaagacatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacagcaactctttccacagtggcacttgccaattaaaatagctgctattatagcawctctgacttttctttacactcttctgagggaagtaantcaccctttagcaacttcccatcaacaatatttttataaaatt

SEQ ID NO: 315 - DNA, 277 bp, Homo Sapiens
  Testis
  sig_peptide 80..235: Von Heijne matrix
  score 3.80
  unsure -40: seq RPVLLHLHQTAHA/DE; position -40 of amino acid sequence; Xaa = Ile,Leu
agcagcagcggcagccgagactcacggtcaagctaaggcgaagagtgggtggctgaagccatactattttatagaattaatggaaagcagaaaagacatcacaaaccaagaagaamtttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacagggg

SEQ ID NO: 316 - DNA, 358 bp, Homo Sapiens
  Colon
  sig_peptide 92..199: Von Heijne matrix
  score 3.70
  unsure 30: seq STLASVPPAATFG/AD; position 30 of amino acid sequence; Xaa = Phe,Ser,Tyr
aagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagthctggtcgaagacgcaggttctggactggatcagctaccaagtggagaagaacaagtacgacgcaacaggg

SEQ ID NO: 317 - DNA, 453 bp, Homo Sapiens
  Muscle
  sig_peptide 85..258: Von Heijne matrix
  score 3.50
  seq LVSFAVSSEGTEQ/GE
  misc_feature 60,417: n=a, g, c or t
  unsure -50: position -50 of amino acid sequence
  unsure -44: Xaa = Ala,Gly,Val
  position -44 of amino acid sequence
  unsure 31: Xaa = Ala,Asp
  position 31 of amino acid sequence
  unsure 40: Xaa = Asp,Glu
  position 40 of amino acid sequence
  unsure 53: Xaa = Lys,Thr; position 53 of amino acid sequence; Xaa = Lys,Asn
aagaccctttcctgaggtccagcaagataatccagatctccagtggcagagagttgagmntgatccaggaaagtgaagcaggagatgcgggactgccccggggtkgaagbgatcctcgactgctctgmcaggcagaagacagaagggtgcaggcttcaggcaggaaaggagtgtgtggattctccagtggaaggaggdcagtcagaagcacctccttctctggtatcctttgccgtctcatcagaaggcacagagcagggagaagatccacgctcggaaaaagatcacagcagacctcacaagcaccgagcgcggcatgcacggctcaggaggagtgaaagcctgtcagamaaacaagtgaaggaagcaaaatctamatgcaaaagcattgcccttcttctaacggatgctcccaancccaactccaagggggtgttgatgtttaagaagcga

SEQ ID NO: 318 - DNA, 311 bp, Homo Sapiens
  Cancerous prostate
  sig_peptide 138..248: Von Heijne matrix; score 3.50; seq LVFNFLLILTILT/IW
aagaatgcttgtgaagtagcaactaaagtggcagtgtttcttctgaaattctcaggcagtcagactgtcttaggcaaatcttgataaaatagcccttatccaggtttttatctaaggaatcccaagaagactggggaatggagagacagtcaagggttatgtcagaaaaggatgagtatcagtttcaacatcagggagcggtggagctgcttgtcttcaattttttgctcatccttaccattttgacaatctggttatttaaaaatcatcgattccgcttcttgcatgaaactggaggagcaatggtgtat

SEQ ID NO: 319 - DNA, 339 bp, Homo Sapiens
  Cancerous prostate
  sig_peptide 190..276: Von Heijne matrix
  score 13.40
  misc_feature 186..315: seq SLLLVQLLTPCSA/QF; blastn; identity 97; region 90..219
  id T70246
  misc_feature 96..184: est; blastn; identity 100; region 1..89
  id T70246
  misc_feature 138..305: est; blastn; identity 97; region 50..217
  id T70127
  misc_feature 302..339: est; blastn; identity 100; region 213..250
  id T70127
  misc_feature 187..305: est; blastn; identity 97; region 62..180
  id AA114263
  misc_feature 127..186: est; blastn; identity 100; region 1..60
  id AA114263
  misc_feature 302..339: est; blastn; identity 100; region 176..213
  id AA114263
  misc_feature 183..339: est; blastn; identity 90; region 73..229
  id T94480
  misc_feature 183..339: est; blastn; identity 90; region 73..229
  id T89056
  unsure 6: est
  position 6 of amino acid sequence
  unsure 7: Xaa =  * ,Gly; position 7 of amino acid sequence; Xaa = Pro,Ser
aatttgctttctctttttcctttcttccggatgagaggctaagccatartagaaagaatggagaattattgattgaccgtctttatwctgtgggctctgattctccaatgggaataccaagggatggttttccatactggaacccaaaggtaaagacactcaaggacagacatttttggcagagcatagatgaaaatggcaagttccctggctttccttctgctcaactttcatgtctccctcctcttggtccagctgctcactccttgctcagctcagttttctgtgcttkgaycctctgggcccatcctggccatggtgggtgaagacgctgatctg

SEQ ID NO: 320 - DNA, 222 bp, Homo Sapiens
  Normal prostate
  sig_peptide 100..195: Von Heijne matrix
  score 12.60
  misc_feature 44..221: seq LLALLTVSTPSWC/QS; blastn; identity 98; region 1..178; id T27536; est
attttttcggtcctgggggagctaggccggcggcagtggtggtggcggcggcgcaagggtgakggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatccccaaaacgg

SEQ ID NO: 321 - DNA, 318 bp, Homo Sapiens
  Hypertrophic prostate
  sig_peptide 220..297: Von Heijne matrix
  score 11.80
  misc_feature 64..282: seq SLLLLLLXCVHWS/QP; blastn; identity 97; region 1..219
  id R93883
  misc_feature 281..320: est; blastn; identity 97; region 219..258
  id R93883
  misc_feature 103..282: est; blastn; identity 97; region 31..210
  id R84338
  misc_feature 281..320: est; blastn; identity 97; region 210..249
  id R84338
  misc_feature 72..108: est; blastn; identity 100; region 1..37
  id R84338
  misc_feature 115..192: est; blastn; identity 94; region 102..179
  id H38350
  misc_feature 222..265: est; blastn; identity 97; region 211..254
  id H38350
  misc_feature 186..225: est; blastn; identity 95; region 174..213
  id H38350
  misc_feature 69..109: est; blastn; identity 90; region 54..94
  id H38350
  misc_feature 102..142: est; blastn; identity 100; region 66..106
  id AA010960
  misc_feature 222..254: est; blastn; identity 93; region 191..223
  id AA010960
  unsure -6: est; position -6 of amino acid sequence; Xaa = Ser,Thr
aagatttcgtttcctgcatctccaaacatggcgacctaggagaaagggaagaacaattttttctcctcttttgggaaggtttgcgtctagtagtgcctgtgcccctgggcagattggagagaagagggacgactggagaatcgtcgagaaccagcggagaaaagaaaaagcaacgtttaattctagaaggcctcctgtccctgcctgctctgggtgctcatggaatcagctgctgccctgcacttctcccggccagcctccctcctcctcctsctcctcasctgtgtgcactggtctcagcccagtttattgtcgtgg

SEQ ID NO: 322 - DNA, 398 bp, Homo Sapiens
  Normal prostate
  sig_peptide 51..110: Von Heijne matrix; score 11.20; seq AFLLLVALSYTLA/RD
agaagcttggaccgcatcctagccgccgactcacacaaggcagagttgccatggaraaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggactcagacatatgaagaagctctatataaatccaagacaagcaacaaacccttgatgattattcatcacttggatgagtgcccacacagtcaagctttaaagaaagtgtttgctgaaaataaagaaatccagaaattggcagagcagtttgtcctcctcaatctggtttatgaaacaactgacaaa

SEQ ID NO: 323 - DNA, 292 bp, Homo Sapiens
  Umbilical cord
  sig_peptide 77..214: Von Heijne matrix
  score 10.30
  misc_feature 47..289: seq LVLLLVLTLLCSL/VP; blastn; identity 97; region 3..245; id H66924; est
aasgccggaagcgcgcggagaccatgtagtgagaccctcgcgaggtctgagagtcactggagctaccagaagcatcatggggccctggggagagccagagctcctggtgtggcgccccgaggcggtagcttcagagcctccagtgcctgtggggctggaggtgaagttgggggccctggtgctgctgctggtgctcaccctcctctgcagcctggtgcccatctgtgtgctgcgccggccaggagctaaccatgaaggctcagcttcccgccagaaagccctgagcccaaag

SEQ ID NO: 324 - DNA, 360 bp, Homo Sapiens
  Cancerous prostate
  sig_peptide 7..54: Von Heijne matrix
  score 10.10
  misc_feature 153..360: seq LLLQLAVLGAALA/AA; blastn; identity 98; region 75..282
  id N29905
  misc_feature 78..176: est; blastn; identity 90; region 1..99
  id N29905
  misc_feature 153..360: est; blastn; identity 98; region 75..282
  id N50844
  misc_feature 78..176: est; blastn; identity 90; region 1..99
  id N50844
  misc_feature 153..360: est; blastn; identity 98; region 75..282
  id N62597
  misc_feature 153..360: est; blastn; identity 98; region 76..283
  id H03409
  misc_feature 153..259: est; blastn; identity 97; region 76..182; id R80247; est
aggagaatggctccgcttctgttgcagctggcggtgctcggcgcggcgctggcggccgcagccctcgtactgatttccatcgttgcatttacaactgctacaaaaatgccagcactccatcgacatgaagaagagaaattcttcttaaatgccaaaggccagaaagaaactttacccagcatatgggactcacctaccaaacaactttctgtcgttgtgccttcatacaatgaagaaaaacggttgcctgtgatgatggatgaagctctgagctatctagagaagagacagaaacgagatcctgcgttcacttatgaagtgatagtagttgatgatggcagtaaagatcagacctcaaag

SEQ ID NO: 325 - DNA, 451 bp, Homo Sapiens
  Lymphocytes
  sig_peptide 71..151: Von Heijne matrix
  score 9.80
  misc_feature 338..453: seq SALLVGFLSVIFA/LV; blastn; identity 100; region 1..116
  id R09346
  misc_feature 338..453: est; blastn; identity 100; region 1..116
  id R06965
  unsure -17: est
  position -17 of amino acid sequence
  unsure 23: Xaa = Ala,Thr
  position 23 of amino acid sequence
  unsure 61: Xaa = Asp,Gly,His,Arg; position 61 of amino acid sequence; Xaa = Gly,Arg
aactacccagagsactgccgccgcctctccaagttcttgtggcccccgcggtgcgsagtatggggcgctgatggccatggagggctactggcgcttcctrrcgctgctggggtcggcactgctcgtcggcttcctgtcggtgatcttcgccctcgtctgggtcctccactaccgagaggggcttggctgggatgggagcgcactagagtttaactggsrcccagtgctcatggtcaccggcttcgtcttcatccagggcatcgccatcatcgtctacagactgccgtggacctggaaatgcagcaagctcctgatgaaatccatccatgcarggttaaatgcagttgctgccattcttgcaattatctctgtggtggccgtgtttgagaaccacaatgttaacaatatagccaatatgtacagtctgcacagctgggttggactgatagct

SEQ ID NO: 326 - DNA, 458 bp, Homo Sapiens
  Lymph ganglia
  sig_peptide 72..122: Von Heijne matrix
  score 9.30
  misc_feature 114..376: seq LALSLLILVLAFG/IP; blastn; identity 98; region 36..298
  id W17274
  misc_feature 371..459: est; blastn; identity 95; region 292..380
  id W17274
  misc_feature 78..120: est; blastn; identity 100; region 1..43
  id W17274
  misc_feature 96..289: est; blastn; identity 98; region 29..222
  id AA149456
  misc_feature 382..459: est; blastn; identity 96; region 317..394
  id AA149456
  misc_feature 292..367: est; blastn; identity 96; region 224..299
  id AA149456
  misc_feature 153..398: est; blastn; identity 95; region 2..247
  id W67885
  misc_feature 381..424: est; blastn; identity 93; region 231..274
  id W67885
  misc_feature 414..443: est; blastn; identity 90; region 265..294
  id W67885
  est
  misc_feature 30: n=a, g, c or t
aacagacccccaacttgcagctgcccaccncaccctcagctctggcctcttactcaccctctaccacagacatggctcagtcactggctctgagcctccttatcctggttctggcctttggcatccccaggacccaaggcagtgatggaggggctcaggactgttgcctcaagtacagccaaaggaagattcccgccaaggttgtccgcagctaccggaagcaggaaccaagcttaggctgctccatcccagctatcctgttcttgccccgcaagcgctctcaggcagagctatgtgcagacccaaaggagctctgggtgcagcagctgatgcagcatctggacaagacaccatccccacagaaaccagcccagggctgcaggaaggacaggggggcctccaagactggcaagaaaggaaarggctccaaaggctgcaagaggactgagcggtcacag

SEQ ID NO: 327 - DNA, 186 bp, Homo Sapiens
  Brain
  sig_peptide 19..63: Von Heijne matrix
  score 8.40
  misc_feature 52..184: seq AMWLLCVALAVLA/WG; blastn; identity 97; region 1..133
  id W93799
  unsure 20: est; position 20 of amino acid sequence; Xaa = Gly,Arg
aagtgctgcttacccatcatggaagcaatgtggctcctgtgtgtggcgttggcggtcttggcatggggcttcctctgggtttgggactcctcagaacgaatgaagagtcgggagcagggargacggctgggagccgaaagccggaccctgctggtcatagcgcaccctgacgatgaagccatgtgg

SEQ ID NO: 328 - DNA, 427 bp, Homo Sapiens
  Brain
  sig_peptide 212..325: Von Heijne matrix
  score 7.80
  misc_feature 266..427: seq LVFTVSLFAWICC/QR; blastn; identity 99; region 137..298
  id AA081755
  misc_feature 129..267: est; blastn; identity 100; region 1..139
  id AA081755
  unsure 20: est; position 20 of amino acid sequence; Xaa =  * ,Lys
aaagaagagccaaaacaggaaccgaggtggcaaatcactgtgcgagggcgagtggacctccctctttgcctcctccctgttccaggagctggtgccctgggctctgcgctgttgttttcagcgctccgaaagccggcgcttgagatccaggcaagtgaatccagccaggcagttttcccttcagcacctcggacagaacacgcagtaaaaaatggctccgatcaccaccagccgggaagaatttgatgaaatccccacagtggtggggatcttcagtgcatttggcctggtcttcacagtctctctctttgcatggatctgctgtcagagaaaatcatccaagtctaacaagactcctccatacaagtttgtgcatgtgcttwagggagttgatatttaccctgaaaacctaaatagcaaaaagaag

SEQ ID NO: 329 - DNA, 400 bp, Homo Sapiens
  Umbilical cord
  sig_peptide 38..91: Von Heijne matrix
  score 7.40
  misc_feature 321..400: seq GWLVLCVLAISLA/SM; blastn; identity 98; region 101..180
  id T53693
  misc_feature 226..307: est; blastn; identity 95; region 8..89; id T53693; est
aatccagtyggasttgacaacaggaggcagaggcatcatggagggtccccggggatggctggtgctctgtgtgctggccatatcgctggcctctatggtgaccgaggacttgtgccgagcaccagacgggaagaaaggggaggcaggaagacctggcagacgggggcggccaggcctcaagggggagcaaggggagccgggggcccctggcatccggacaggcatccaaggccttaaaggagaccagggggaacctgggccctctggaaaccccggcaaggtgggctacccagggcccagcggccccctcggagcccgtggcatcccgggaattaaaggcaccaagggcagcccaggaaacatcaaggaccagccgaggccagccttctccgccattcgg

SEQ ID NO: 330 - DNA, 288 bp, Homo Sapiens
  Muscle
  sig_peptide 52..240: Von Heijne matrix
  score 7.20
  misc_feature 42..132: seq VLLTLLLIAFIFL/II; blastn; identity 95; region 1..91
  id N77056
  est
  misc_feature 152: n=a, g, c or t
  unsure -39: position -39 of amino acid sequence
  unsure -38,-37: Xaa = Ala,Pro
  position -38, -37 of amino acid sequence
  unsure -30: Xaa = Pro,Gln; position -30 of amino acid sequence; Xaa = His,Leu,Pro,Arg
aagtcttagacgactgcgtcgtgctatgaccggactttttcttgaaaggggatgacagcatgggaggcaatggctccacatgtaaacccgacactgaaagacaaggcactctctccacagcagscccmacmaactagccctgcaccctgtcnytctaaccaccacaacaaaaaacatttaatccttgccttttgtgctggggttctactgacactgctgctgatagcctttatcttcctcatcataaagagctacagaaaatatcactccaagccccaggcccccggg

SEQ ID NO: 331 - DNA, 333 bp, Homo Sapiens
  kidney
  sig_peptide 136..189: Von Heijne matrix
  score 7.10
  misc_feature 211..313: seq LLCECLLLXAGYA/HD; blastn; identity 100; region 2..104
  id N57441
  est
  misc_feature 177: n=a, g, c or t
  unsure -5: position -5 of amino acid sequence
  unsure 44: Xaa = Ala,Val; position 44 of amino acid sequence; Xaa = Asp,Gly
gaacaattcgatgacgaggcccaggaagcacgctgaaaccctgggcggcggcaagctgtgcgacctcttctgcggccggcctgggcaggtgtcttcctcgagaggcaggcaggggatcbcggacccttatacaggatgctgtgttctttgctcctttgtgaatgtctgttgctggyngctggttatgctcatgatgatgactggattgaccccacagacatgcttaactatgatgctgcttcaggaacaatgagaaaatctcaggcaaaatatggtatttcaggggaaaaggatgtcagtcctgacttgtcatgtgctgrtgaaatatcagaa

SEQ ID NO: 332 - DNA, 462 bp, Homo Sapiens
  kidney
  sig_peptide 325..381: Von Heijne matrix
  score 6.90
  misc_feature 158..307: seq LVXSLPVHCLTFA/SS; blastn; identity 97; region 129..278
  id R18809
  misc_feature 99..157: est; blastn; identity 98; region 71..129
  id R18809
  misc_feature 323..371: est; blastn; identity 95; region 299..347
  id R18809
  misc_feature 305..441: est; blastn; identity 96; region 141..277
  id R88070
  misc_feature 167..300: est; blastn; identity 97; region 1..134
  id R88070
  misc_feature 158..307: est; blastn; identity 96; region 68..217
  id T85919
  misc_feature 98..157: est; blastn; identity 98; region 9..68
  id T85919
  misc_feature 158..317: est; blastn; identity 93; region 129..288
  id R60434
  misc_feature 99..157: est; blastn; identity 98; region 71..129
  id R60434
  misc_feature 158..307: est; blastn; identity 96; region 86..235
  id W23910
  misc_feature 98..157: est; blastn; identity 96; region 27..86
  id W23910
  est
  misc_feature 348: n=a, g, c or t
  unsure -11: position -11 of amino acid sequence
  unsure 15: Xaa = Leu,Val
  position 15 of amino acid sequence
  unsure 20: Xaa = Asn,Thr; position 20 of amino acid sequence; Xaa = His,Gln
aagttggtggagttctgcccggatggaagctccggccgcggagtgatggtggcctcagcgaagatgggccgggcagggaccatggcggtggcagcagagcttcgagagctgtgcccaggagtgaacaaccagccctacctctgtgagagtkgtcacttgctgcggggaamctggctgctgcacctactactatgagctctggtggttctggctgctctggactgtcctcatcctctttagctgctgttgcgccttccgccaccgacgagctaaactcaggctgcaacaacagcagcggcasstgaaacaacttgttggcctatcatggggcatgccatggggctggtnstttccctaccggttcactgcttgaccttcgcttcctcagcaccttcaagcccccagcctacgaggatgtggttcamcgcccaggcacaccamcccccccttatactgggcccg

SEQ ID NO: 333 - DNA, 451 bp, Homo Sapiens
  Umbilical cord
  sig_peptide 104..151: Von Heijne matrix
  score 6.70
  misc_feature 156..288: seq CFSLVLLLTSIWT/TR; blastn; identity 100; region 1..133
  id AA081350
  misc_feature 289..396: est; blastn; identity 99; region 133..240
  id AA081350
  misc_feature 422..453: est; blastn; identity 90; region 269..300
  id AA081350
  misc_feature 289..453: est; blastn; identity 99; region 67..231
  id AA046671
  misc_feature 222..289: est; blastn; identity 100; region 1..68; id AA046671; est
aatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcagctatggctgggttggagatggattcgtggtcatctctaggattagcccaaaccccaagtgtgggaaaaatggggtgggtgtcctgatttgg

SEQ ID NO: 334 - DNA, 369 bp, Homo Sapiens
  kidney
  sig_peptide 175..351: Von Heijne matrix
  score 6.60
  misc_feature 67..366: seq VLAQLAFLSQISQ/CI; blastn; identity 99; region 2..301
  id AA056199
  misc_feature 152..366: est; blastn; identity 100; region 1..215
  id R66275
  misc_feature 117..221: est; blastn; identity 97; region 99..203
  id AA054476
  misc_feature 39..120: est; blastn; identity 96; region 22..103
  id AA054476
  misc_feature 232..366: est; blastn; identity 100; region 1..135
  id AA143025
  misc_feature 242..366: est; blastn; identity 99; region 84..208; id W90481; est
acttttccggctgacttctgagaaggttgcgcasagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagcgg

SEQ ID NO: 335 - DNA, 414 bp, Homo Sapiens
  Cancerous prostate
  sig_peptide 199..282: Von Heijne matrix
  score 6.60
  misc_feature 286..414: seq IVSLLGFVATVTL/IP; blastn; identity 96; region 211..339
  id AA284366
  misc_feature 166..300: est; blastn; identity 92; region 92..226
  id AA284366
  misc_feature 72..177: est; blastn; identity 98; region 1..106
  id AA284366
  est
  misc_feature 181: n=a, g, c or t
agaacataggttgccttagagaggttccccggtgtcccgacggcggctcaagtcagagttgctgggttttgctcagattggtgtgggaagagcctgcctgtggggagcggccactccatactgctgargcctcaggactgctgctcagcttgcccgttacctgaagaggcggcggagcggngcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccgacagcagatcccagaatcccagggagtgatcagcggtgctgttttccttatcatcctcttctgc

SEQ ID NO: 336 - DNA, 457 bp, Homo Sapiens
  Hypertrophic prostate
  sig_peptide 212..280: Von Heijne matrix
  score 5.40
  misc_feature 209..341: seq PASLSLLTFKVYA/AP; blastn; identity 99; region 241..373
  id H87867
  misc_feature 28..124: est; blastn; identity 98; region 63..159
  id H87867
  misc_feature 168..207: est; blastn; identity 92; region 201..240
  id H87867
  misc_feature 224..459: est; blastn; identity 99; region 1..236
  id N87591
  misc_feature 263..453: est; blastn; identity 100; region 65..255
  id AA172091
  misc_feature 202..251: est; blastn; identity 94; region 4..53
  id AA172091
  misc_feature 263..459: est; blastn; identity 100; region 38..234
  id H85080
  misc_feature 225..261: est; blastn; identity 100; region 1..37; id H85080; est
gacgcgctgcggctcagcgacgcggcttctagaaccgggtgattgaactaaaccttcgccgcaccgagtttgcagtacggccgtcacccgcaccgctgcctgcttgcggttggagaaatcaargggccctaccgggcctccgtagtcacctctctatagtgggcgtggccgaggccggggtgaccctgccggagcctccgctgccagcgacatgttcaaggtaattcagaggtccgtggggccagccagcctgagcttgctcaccttcaaagtctatgcagcaccaaaaaaggactcacctcccaaaaattccgtgaaggttgatgagctttcactctactcagttcctgagggtcaatcgaagtatgtggaggaggcaaggagccagcttgaagaaagcatctcacagctccgacactattgcgagccatacacaacctggtgtcaggaaacgtac

SEQ ID NO: 337 - DNA, 439 bp, Homo Sapiens
  kidney
  sig_peptide 20..427: Von Heijne matrix
  score 5.40
  misc_feature 141..354: seq LISVALVQGWALG/GG; blastn; identity 99; region 38..251
  id T94226
  misc_feature 225..373: est; blastn; identity 100; region 1..149
  id W95280
  misc_feature 371..437: est; blastn; identity 98; region 148..214
  id W95280
  misc_feature 167..289: est; blastn; identity 91; region 2..124
  id N55978
  misc_feature 262..326: est; blastn; identity 98; region 98..162
  id N55978
  misc_feature 379..437: est; blastn; identity 100; region 270..328
  id N55978
  misc_feature 317..373: est; blastn; identity 94; region 154..210; id N55978; est
aaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggactccagagacttcctttaataagtgttgcgctggttcaaggttgggcattgggtggaggagcagcg

SEQ ID NO: 338 - DNA, 323 bp, Homo Sapiens
  Substantia nigra
  sig_peptide 132..263: Von Heijne matrix
  score 5.30
  misc_feature 116..212: seq PLLKILHAAGAQG/EM; blastn; identity 95; region 125..221
  id HUMEST2D1
  misc_feature 214..322: est; blastn; identity 99; region 9..117
  id AA115085
  unsure -19: est; position -19 of amino acid sequence; Xaa = Ala,Glu,Gly,Pro,Gln,Arg
aatttcavvatgctgccgaggccctaggatctgtgactgccacccctccccccacccgggctcggcgggggagcgactcatggagctgccgtaagttttaccaacagactgcagtttctttcactaccaaaatgacatcattttccacctctgctcagtgttcaacatctgacagtgcttgcaggatctctcctggacaaatcaatsvggtacgaccaaaactgccgcttttgaagattttgcatgcagcaggtgcgcaaggtgaaatgttcactgttaaagaggtcatgcactatttaggtcagtacataatggtgaagcag

SEQ ID NO: 339 - DNA, 478 bp, Homo Sapiens
  Lung (cells)
  sig_peptide 5..340: Von Heijne matrix
  score 5.10
  misc_feature 104..370: seq AFAWLGVVPLTAC/RI; blastn; identity 99; region 1..267
  id AA114062
  misc_feature 409..451: est; blastn; identity 93; region 309..351
  id AA114062
  misc_feature 388..420: est; blastn; identity 90; region 287..319
  id AA114062
  est
  misc_feature 106: n=a, g, c or t
  unsure -79: position -79 of amino acid sequence; Xaa = Phe,Leu
aaagatggacaccgcggaggaagacatatgtagagtgtgtcggtcagaaggaacacctgagaaaccgctttatcatccttgtgtatgtactggcagtattaagttngtccatcaagaatgcttagttcaatggctgaaacacagtcgaaaagaatactgtgaattatgcaagcacagatttgcttttacaccaatttattctccagatatgccttcacggcttccaattcaagacatatttgctggactggttacaagtattggcactgcaatacgatattggtttcattatacacttgtggcctttgcatggttgggagttgttcctcttacagcatgccgcatctacaagtgcttgtttactggctccgtgagctcactactgacgctgccattagatatgctgtcaacggaaaatttgttggcagattgtttgcagggttgttttgtggtgacgtgcacactgtgtgcattcatc

SEQ ID NO: 340 - DNA, 275 bp, Homo Sapiens
  Brain
  sig_peptide 153..191: Von Heijne matrix
  score 4.90
  misc_feature 133..273: seq MLIMLGIFFNVHS/AV; blastn; identity 98; region 87..227
  id W31692
  misc_feature 45..121: est; blastn; identity 100; region 1..77
  id W31692
  misc_feature 123..273: est; blastn; identity 94; region 76..226
  id H46855
  misc_feature 47..122: est; blastn; identity 100; region 1..76
  id H46855
  misc_feature 133..273: est; blastn; identity 98; region 85..225
  id H49687
  misc_feature 47..121: est; blastn; identity 100; region 1..75
  id H49687
  misc_feature 133..273: est; blastn; identity 97; region 84..224
  id H50194
  misc_feature 47..121: est; blastn; identity 100; region 1..75
  id H50194
  misc_feature 133..273: est; blastn; identity 98; region 82..222
  id AA285085
  misc_feature 50..122: est; blastn; identity 100; region 1..73
  id AA285085
  est
  misc_feature 238: n=a, g, c or t
  unsure 16: position 16 of amino acid sequence; Xaa = Ile,Asn,Ser,Thr
ccctgcgagggcatcctgggctttctcccaccgctttccgagcccgcttgcacctcggcgatccccgactcccttctttatggcgtcgctcctgtgctgtgggccgaagctggccgcctgcggcatcgtgyrtcagcgcctggggagtgatcatgttgataatgctcggaatatttttcaatgtccattccgctgtgttgattgaggacgttcccttcacggagaaagattttgagantggcccccagaacatatacaacctttacgagcatggg

SEQ ID NO: 341 - DNA, 350 bp, Homo Sapiens
  Normal prostate
  sig_peptide 9..344: Von Heijne matrix
  score 4.50
  misc_feature 82..223: seq AAVAVGMLXASYA/AV; blastn; identity 100; region 1..142
  id W24852
  misc_feature 231..320: est; blastn; identity 92; region 150..239
  id W24852
  misc_feature 256..321: est; blastn; identity 90; region 1..66
  id AA129007
  misc_feature 321..350: est; blastn; identity 90; region 65..94
  id AA129007
  est
  misc_feature 329..330: n=a, g, c or t
  unsure -29: position -29 of amino acid sequence
  unsure -22: Xaa = Gly,Leu,Arg,Val
  position -22 of amino acid sequence
  unsure -5: Xaa = Lys,Gln; position -5 of amino acid sequence; Xaa = Gly,Arg,Trp
agagggttatgggagggctctggcgtcctggatggaggtgcgttcctttctgtggctggcgctggatccaccctgggtctccaaccagggctgcagagagggtagagccgtttcttaggccagagtggagtgggacaggaggtgccgagagaggactgaggtggcttgggacatggaagcgctgcagccttcgagcccggcatccagcattgcagccgccgcggcggcctaagagctcgaaccctttcacacgcgcgskvgaggaggarcggcggcggmagaacaagacgaccctcacttacgtggccgctgtcgccgtgggcatgctnngggcgtcctacgctgccgta

SEQ ID NO: 342 - DNA, 419 bp, Homo Sapiens
  kidney
  sig_peptide 132..248: Von Heijne matrix
  score 4.20
  misc_feature 71..256: seq SDPLCVLFLNTSG/QQ; blastn; identity 99; region 1..186
  id W32758
  unsure 44: est; position 44 of amino acid sequence; Xaa = Asp,Gly
aaatccctgcggtcccagcgtcgctccggacgctgccaacctgttctccaccgtcgctcgacttccacctctaagactcccacgaaactcaggttgaataattcatcaaattacacaactgaactcaagacatggctgcccagtgtgtcacaaaggtggcgctgaatgtttcctgtgccaatcttttggataaagatatagggtcaaagtcagaccctttatgtgtgttatttttgaatacaagtggtcaacagtggtatgaggttgagcgcacagaaaggattaagaattgcttgaatccccaattttccaagacatttattattgattactactttgaagtggttcagaaattgaaatttggggtttatgacatcgrcaacaaaactattgagctgagtgatgatgacttcttaggg

SEQ ID NO: 343 - DNA, 405 bp, Homo Sapiens
  kidney
  sig_peptide 85..294: Von Heijne matrix
  score 3.70
  misc_feature 63..402: seq AVLDCAFYDPTHA/WS; blastn; identity 98; region 35..374
  id W79829
  misc_feature 77..377: est; blastn; identity 98; region 1..301
  id H81957
  misc_feature 373..404: est; blastn; identity 90; region 298..329
  id H81957
  misc_feature 88..402: est; blastn; identity 99; region 2..316
  id H62624
  unsure 8: est
  position 8 of amino acid sequence
  unsure 9: Xaa = His,Pro,Gln; position 9 of amino acid sequence; Xaa = Leu,Val
aagtgttctgagggaagcaaggaggcggcggcggccgcagcgagtggcgagtagtggaaacgttgcttctgaggggagcccaagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcmvktgaaaatgcatgatttgaacactgatcaagaaaatcttgttgggacccatgatgcccctatcagatgtgttgaatactgtccaagt

SEQ ID NO: 344 - DNA, 442 bp, Homo Sapiens
  Brain
  sig_peptide 299..373: Von Heijne matrix
  score 3.60
  misc_feature 48..365: seq AHLCWCGSHCCST/CV; blastn; identity 99; region 1..318
  id N31699
  misc_feature 365..420: est; blastn; identity 100; region 319..374; id N31699; est
agtgttccctcaaatggcggtgtgaagagagttcgcctgagccagatcccaggtttcactgaagaaacttcttagagattcattgcacttctgagatttaatgtttacaacttggagttgtcgaccttcttataagatacattttggaagtcaaaatgaaagttttctgtgaagttttagaagagttatacaagaaggtacttcttggagccacacttgaaaatgacagccatgattacgtcttttatctcaacccagcagtttcagatcaagattgttctacagccacctccttagaatgggcaaacacctgtggtatccagggcaggcatcagcccatctctgttggtgtggctcccattgctgtagcacctgtgtgtttgaagaccaactctcagatgagcggttccagagaagtaatgctccttcagttaacagtgat

SEQ ID NO: 345 - DNA, 391 bp, Homo Sapiens
  kidney
  sig_peptide 173..211: Von Heijne matrix
  score 3.50
  misc_feature 81..386: seq MLAVSLTVXLLGA/MM; blastn; identity 99; region 3..308
  id T23663
  misc_feature 81..386: est; blastn; identity 98; region 3..308
  id T23653
  misc_feature 90..386: est; blastn; identity 99; region 1..297
  id T03538
  misc_feature 126..342: est; blastn; identity 97; region 1..217
  id H28147
  misc_feature 356..386: est; blastn; identity 96; region 233..263
  id H28147
  misc_feature 144..368: est; blastn; identity 99; region 1..225
  id R71352
  unsure -5: est; position -5 of amino acid sequence; Xaa = Leu,Pro,Arg
agtgaggtggtttctgcgggtgaggctggcgcccgtaccatgagcgaggcggacgggctgcgacagcgccggcccctgcggcccgcaagtcgtcacagacgatgatggccaggccccggaggctaaggacggcagctcctttagcggcagagttttccgagtgaccttcttgatgctggctgtttctctcaccgttcbcctgcttggagccatgatgctgctggaatctcctatagatccacagcctctcagcttcaaagaacccccgctcttgcttggtgttctgcatccaaatacgaagctgcgacaggcagaaaggctgtttgaaaatcaacttgttggaccggagtccatagcacatattggggatgtgatgtttactgggagctgg

SEQ ID NO: 346 - DNA, 339 bp, Homo Sapiens
  Ovary
  sig_peptide 82..309: Von Heijne matrix
  score 3.50
  misc_feature 76..203: seq MLELDLLVFHLWG/SQ; blastn; identity 100; region 1..128
  id R57344
  misc_feature 204..235: est; blastn; identity 100; region 128..159; id R57344; est
aagtagcgcctgcwggcggyggcagtttgcccgcggrwgtgtgaagggagacagtgtggaggccacagggtactcgccacgatgagcagcaccttagctaagatcgcggagatagaagcagagatggctcggactcaaaagaacaaggccacagcacaccacttagggctgcttaaggctcgtcttgctaagcttcgtcgagaactcattactccaaagggtggtggtggtggaggtccaggagaaggttttgattggccaagacaggtgatgctcgaattggatttgttggttttccatctgtggggaagtcaacactgcttagtaacctggcaaggg

SEQ ID NO: 347 - DNA, 217 bp, Homo Sapiens
  kidney
  sig_peptide 47..181: Von Heijne matrix
  score 13.90
  misc_feature 17..214: seq LVLALLLVSAALS/SV; blastn; identity 100; region 1..198
  id C18087
  misc_feature 53..140: est; blastn; identity 100; region 2..89
  id T73970
  misc_feature 128..214: est; blastn; identity 91; region 76..162
  id T73970
  misc_feature 93..140: est; blastn; identity 100; region 44..91
  id T73946
  misc_feature 60..142: est; blastn; identity 92; region 13..95
  id AA096472
  misc_feature 144..173: est; blastn; identity 96; region 96..125
  id AA096472
  misc_feature 169..214: est; blastn; identity 100; region 1..46; id AA280423; est
atggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccgccgctctatccagtgttgtatcacggactgattcaccgagcccactg

SEQ ID NO: 348 - DNA, 372 bp, Homo Sapiens
  kidney
  sig_peptide 184..258: Von Heijne matrix
  score 13.90
  misc_feature 147..264: seq LLSLLFLVQGAHG/RG; blastn; identity 97; region 152..269
  id AA015703
  misc_feature 316..366: est; blastn; identity 94; region 322..372
  id AA015703
  misc_feature 257..302: est; blastn; identity 97; region 261..306
  id AA015703
  unsure 28: est; position 28 of amino acid sequence; Xaa = Asp,Glu
aacaaagagttggcagatcacggatggagggcagcatctcccaacagcctgggcggccgctgagacccagagaacccaaggactcccctkgggggywcayccagcagcctctgcttcccaggagagaggtgctgaagtccacgaagaggtggtgacttccaagagtgactccgtcggaggaaaatgactccccagtcgctgctgcagacgacactgttcctgctgagtctgctcttcctggtccaaggtgcccacggcaggggccacagggaagactttcgcttctgcagccagcggaaccagacacacaggagcagcctccactayaaacccacaccagamctgcgcatctccatcgagaactccgaagag

SEQ ID NO: 349 - DNA, 439 bp, Homo Sapiens
  Testis
  sig_peptide 59..322: Von Heijne matrix
  score 11.60
  misc_feature 36..390: seq ILLCLLLALFASG/LI; blastn; identity 98; region 43..397
  id W31335
  misc_feature 2..34: est; blastn; identity 96; region 10..42
  id W31335
  misc_feature complement(151..440): est; blastn; identity 98; region 64..353
  id N30852
  misc_feature complement(82..157): est; blastn; identity 96; region 348..423
  id N30852
  misc_feature 51..314: est; blastn; identity 97; region 1..264
  id HSPD03622
  misc_feature 311..375: est; blastn; identity 92; region 262..326
  id HSPD03622
  misc_feature 389..434: est; blastn; identity 93; region 342..387
  id HSPD03622
  misc_feature 2..316: est; blastn; identity 98; region 9..323
  id AA055130
  misc_feature 316..375: est; blastn; identity 96; region 324..383
  id AA055130
  misc_feature 145..436: est; blastn; identity 95; region 123..414
  id H19862
  misc_feature 50..110: est; blastn; identity 95; region 26..86
  id H19862
  misc_feature 107..145: est; blastn; identity 97; region 84..122
  id H19862
  unsure 4: est; position 4 of amino acid sequence; Xaa = Gln,Arg
aacccggttcagctcgcctttcttggccagaggcgccggttggactcacgggcggggcatgatggtggtgggtacgggcacctcgctggcgctctcctccctcctgtccctgctgctctttgctgggatgcagatttacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccragtctgtgtcaccacctgcttcatcttctccagggttggtctgtactacatcaacaagatctcctccaccctgtaccaggcagcagctccagtcctcacaccagcc

SEQ ID NO: 350 - DNA, 457 bp, Homo Sapiens
  Lymph ganglia
  sig_peptide 56..112: Von Heijne matrix
  score 11.60
  misc_feature 11..74: seq VFCLLAVAPGAHS/QE; blastn; identity 93; region 1..64
  id R86288
  misc_feature 217..251: est; blastn; identity 97; region 204..238; id T29670; est
atccaacaaccacatcccttctctacagaagcctctgagaagaaagttcttcaccatggactggacctggagggtcttctgcttgctggctgtagctccaggtgctcactcccaggaacaactggtgcagtctggggctgaggtgttgaagcctggggcctcagtgaacatttcctgcagggcatctgggttcaccttcaccaattattatgtgcactgggtgcgacaggcccctggacacgggcttgagtggatgggagtgatcaaccccgttagtggttacacaagttacgcacagaaactgcagggcagactgaccatgaccacggacacggccgcgaatatagtctacatggacctcagtaggctgaaatctgacgacacggccgtgtatttctgtgcgaaagtgcggtgtcttaaggggatatgctatacagaggatgctctggatctttgg

SEQ ID NO: 351 - DNA, 439 bp, Homo Sapiens
  Umbilical cord
  sig_peptide 23..361: Von Heijne matrix
  score 11.60
  misc_feature 75..429: seq ILLCLLLALFASG/LI; blastn; identity 99; region 43..397
  id W31335
  misc_feature 32..73: est; blastn; identity 97; region 1..42
  id W31335
  misc_feature 33..355: est; blastn; identity 98; region 1..323
  id AA055130
  misc_feature 355..414: est; blastn; identity 100; region 324..383
  id AA055130
  misc_feature 56..384: est; blastn; identity 96; region 28..356
  id AA252648
  misc_feature 385..428: est; blastn; identity 100; region 356..399
  id AA252648
  misc_feature 113..439: est; blastn; identity 99; region 38..364
  id AA228934
  misc_feature 184..440: est; blastn; identity 99; region 123..379
  id H19862
  misc_feature 89..149: est; blastn; identity 90; region 26..86
  id H19862
  misc_feature 146..184: est; blastn; identity 100; region 84..122
  id H19862
  unsure -76: est; position -76 of amino acid sequence; Xaa = Cys,Ser,Trp
aagtccgcggtaaggctgacgcatgcgcatagctaaccgcacccggttcagctcgcctttcttggccagaggcgccggttggactcacgggcggggcatgatggtggtgggtacgggcacctcgctggcgctctsstccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcctcatccaccgagtctgtgtcaccacctgcttcatcttctccatggttggtctgtactacatcaacaagatctcctcc

SEQ ID NO: 352 - DNA, 309 bp, Homo Sapiens
  Heart
  sig_peptide 151..222: Von Heijne matrix
  score 11.40
  misc_feature 16..250: seq LMSLLLVLPVVEA/VE; blastn; identity 99; region 1..235
  id AA280774
  misc_feature 246..282: est; blastn; identity 100; region 230..266
  id AA280774
  misc_feature 17..259: est; blastn; identity 99; region 1..243
  id HUM404F03B
  misc_feature 20..282: est; blastn; identity 100; region 1..263
  id W05476
  misc_feature 21..282: est; blastn; identity 100; region 1..262
  id R33542
  misc_feature 12..282: est; blastn; identity 100; region 8..278; id T85491; est
adtcctgtaatggctgcttcctagaaggtcgtgtcacgtggaacctcttaatctcagcatccggagctccaggaagggaaaatttcaagtcagatagaattctatatataccatttctttggaaccttcagccctcaagattccaacatcatgacctcagtttcaacacagttgtccttagtcctcatgtcactgcttttggtgctgcctgttgtggaagcagtagaagccggtgatgcaatcgcccttttgttaggtgtggttctcagcattacaggcattgtgcctgcttgggggtatatgcayggg

SEQ ID NO: 353 - DNA, 361 bp, Homo Sapiens
  Brain
  sig_peptide 263..322: Von Heijne matrix
  score 11.20
  misc_feature 95..363: seq ILVVLMGLPLAQA/LD; blastn; identity 98; region 60..328
  id H19572
  misc_feature 140..290: est; blastn; identity 98; region 106..256
  id H46195
  misc_feature 95..148: est; blastn; identity 92; region 62..115
  id H46195
  misc_feature complement(207..316): est; blastn; identity 99; region 183..292
  id H46196
  misc_feature complement(314..363): est; blastn; identity 98; region 137..186
  id H46196
  misc_feature complement(172..212): est; blastn; identity 95; region 288..328
  id H46196
  misc_feature complement(237..287): est; blastn; identity 92; region 239..289
  id H19490
  misc_feature complement(284..317): est; blastn; identity 97; region 208..241
  id H19490
  misc_feature complement(331..363): est; blastn; identity 93; region 160..192
  id H19490
  est
  misc_feature 341: n=a, g, c or t
  unsure 7: position 7 of amino acid sequence; Xaa = Ala,Pro,Ser,Thr
aagacacgcctacgattagactcaggcaggcacctaccggcgagcggccgcrvgtgactcccaggcgcggcggtacctcacggtggtgaaggtcacagggttgcagcactcccagtagaccaggagctccgggaggcagggccggccccacgtcctctgcgcaccaccctgagttggatcctctgtgcgccacccctgagttggatccagggctagctgctgttgacctccccactcccacgctgccctcctgcctgcagccatgacgcccctgctcaccctgatcctggtggtcctcatgggcttacctctggcccaggccttggactgccacgtgtgtncctacaacggagacaactgc

SEQ ID NO: 354 - DNA, 510 bp, Homo Sapiens
  Lymph ganglia
  sig_peptide 139..186: Von Heijne matrix
  score 11.00
  misc_feature 20..372: seq LLALSLLVLWTSP/AP; blastn; identity 99; region 1..353
  id W05519
  misc_feature 368..423: est; blastn; identity 96; region 348..403
  id W05519
  misc_feature 17..260: est; blastn; identity 99; region 21..264
  id T97490
  misc_feature 281..341: est; blastn; identity 96; region 287..347
  id T97490
  misc_feature 16..315: est; blastn; identity 99; region 1..300
  id HUML12811
  misc_feature 16..275: est; blastn; identity 98; region 1..260
  id HUML13801
  unsure 79: est
  position 79 of amino acid sequence
  unsure 83: Xaa = Arg,Ser
  position 83 of amino acid sequence
  unsure 86: Xaa =  * ,Glu
  position 86 of amino acid sequence
  unsure 88: Xaa = Asn,Thr
  position 88 of amino acid sequence
  unsure 100: Xaa = Lys,Gln
  position 100 of amino acid sequence
  unsure 103: Xaa = Asp,Tyr
  position 103 of amino acid sequence
  unsure 107: Xaa = Pro,Thr; position 107 of amino acid sequence; Xaa = Gly,Arg
aattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctagttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaarmgccgmagcagtkaacctatgamcgtgmagagggarccggagtccgagtcaagcattgtgaatkattacctamctggggaacgargaagg

SEQ ID NO: 355 - DNA, 382 bp, Homo Sapiens
  Umbilical cord
  sig_peptide 74..136: Von Heijne matrix
  score 10.50
  misc_feature 152..287: seq RLLLLPLLLAVSG/LR; blastn; identity 95; region 91..226
  id W60940
  misc_feature 108..160: est; blastn; identity 100; region 48..100
  id W60940
  misc_feature 60..106: est; blastn; identity 100; region 1..47
  id W60940
  misc_feature 152..316: est; blastn; identity 94; region 90..254
  id H39980
  misc_feature 62..160: est; blastn; identity 100; region 1..99
  id H39980
  misc_feature 308..384: est; blastn; identity 94; region 247..323
  id H39980
  misc_feature complement(148..292): est; blastn; identity 99; region 282..426
  id N41026
  misc_feature complement(283..384): est; blastn; identity 93; region 191..292
  id N41026
  misc_feature 66..160: est; blastn; identity 97; region 8..102
  id R49793
  misc_feature 199..271: est; blastn; identity 97; region 141..213
  id R49793
  misc_feature 152..199: est; blastn; identity 91; region 93..140
  id R49793
  misc_feature 18..160: est; blastn; identity 96; region 1..143
  id W74783
  misc_feature 190..253: est; blastn; identity 98; region 173..236
  id W74783
  est
  misc_feature 306: n=a, g, c or t
  unsure 57: position 57 of amino acid sequence; Xaa = Ala,Glu,Gly,Leu,Pro,Gln,Arg,Val
aatttcacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcasngacccggaaacagcgtatcactgagaccgggtcgccttatcaggagctccagggtcagaggtcggatgtctacagc

SEQ ID NO: 356 - DNA, 423 bp, Homo Sapiens
  kidney
  sig_peptide 178..249: Von Heijne matrix
  score 10.00
  misc_feature 54..196: seq LCRALCLFPRVFA/AE; blastn; identity 96; region 13..155
  id N41450
  misc_feature 193..332: est; blastn; identity 92; region 153..292
  id N41450
  misc_feature 327..425: est; blastn; identity 98; region 288..386
  id N41450
  misc_feature 204..332: est; blastn; identity 95; region 202..330
  id W76359
  misc_feature 54..124: est; blastn; identity 100; region 54..124
  id W76359
  misc_feature 2..53: est; blastn; identity 100; region 3..54
  id W76359
  misc_feature 327..370: est; blastn; identity 97; region 326..369
  id W76359
  misc_feature 164..196: est; blastn; identity 100; region 162..194
  id W76359
  misc_feature 133..163: est; blastn; identity 100; region 132..162
  id W76359
  misc_feature 54..128: est; blastn; identity 96; region 46..120
  id W04321
  misc_feature 9..54: est; blastn; identity 97; region 2..47
  id W04321
  misc_feature 164..201: est; blastn; identity 94; region 153..190
  id W04321
  misc_feature 125..163: est; blastn; identity 92; region 115..153
  id W04321
  misc_feature 2..124: est; blastn; identity 100; region 12..134
  id AA025985
  misc_feature 200..286: est; blastn; identity 95; region 208..294
  id AA025985
  misc_feature 366..425: est; blastn; identity 100; region 381..440
  id AA025985
  misc_feature 135..166: est; blastn; identity 96; region 145..176
  id AA025985
  misc_feature 208..306: est; blastn; identity 96; region 146..244
  id H09017
  misc_feature 62..126: est; blastn; identity 98; region 1..65
  id H09017
  misc_feature 327..368: est; blastn; identity 92; region 267..308
  id H09017
  unsure 21: est
  position 21 of amino acid sequence
  unsure 38: Xaa = Leu,Val; position 38 of amino acid sequence; Xaa = Phe,Leu
aaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacstcccagagccctattaccggaatctggatgggaccgcctccgggagctgtttkgcaaagatgaacagcagagaatttcaaaggaccttgctaatatctgtaagacggcagcta

SEQ ID NO: 357 - DNA, 356 bp, Homo Sapiens
  Cancerous prostate
  sig_peptide 75..131: Von Heijne matrix
  score 9.50
  misc_feature 8..208: seq LMCLSLCTAFALS/KP; blastn; identity 100; region 1..201
  id N56128
  misc_feature 242..311: est; blastn; identity 94; region 233..302
  id N56128
  misc_feature 207..244: est; blastn; identity 94; region 199..236
  id N56128
  misc_feature 19..113: est; blastn; identity 100; region 1..95
  id N87312
  misc_feature 223..286: est; blastn; identity 90; region 208..271
  id N87312
  misc_feature 181..222: est; blastn; identity 92; region 165..206
  id N87312
  misc_feature 46..270: est; blastn; identity 97; region 1..225
  id R57616
  misc_feature 51..241: est; blastn; identity 99; region 1..191
  id AA093451
  unsure 27: est
  position 27 of amino acid sequence
  unsure 41: Xaa = Asp,Val; position 41 of amino acid sequence; Xaa = Arg,Ser,Thr
agagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgwttatgaccatgatgccttcttgggtgctgaagaagcaaagasmtttgatcagctgacaccagaagagagcaaggaaaggcttggaaagattgtaagtaaratmgatggcgacaaggacgggtttgtcactgtggatgagctcaaa

SEQ ID NO: 358 - DNA, 320 bp, Homo Sapiens
  Substantia nigra
  sig_peptide 24..113: Von Heijne matrix
  score 9.50
  misc_feature 50..320: seq LLFLSQFCILSGG/ES; blastn; identity 96; region 17..287
  id R35366
  misc_feature 42..320: est; blastn; identity 97; region 10..288
  id R35909
  misc_feature 42..318: est; blastn; identity 97; region 10..286
  id R20566
  misc_feature 42..320: est; blastn; identity 96; region 10..288
  id H09254
  misc_feature 42..320: est; blastn; identity 96; region 10..288
  id R25274
  unsure 45: est
  position 45 of amino acid sequence
  unsure 62: Xaa = Ala,Thr; position 62 of amino acid sequence; Xaa = Asp,Asn
aaaagtgcgcaggcgctggcaagatggcgggaggggtgcgcccgctgcggggcctccgcgccttgtgtcgcgtgctgctcttcctctcgcagttctgcattctgtcgggcggtgaaagtactgaaatcccaccttatgtgatgaagtgtccgagcaatggtttgtgtagcaggcttcctgcagactgtatagacagcacaacaaatttctcctgtacctatgggaagcctgtmacttttgactgtrcagtgaaaccatctgttacctgtgttgatcaagacttcaaatcccaaaagracttcatcattaacatgacttgc

SEQ ID NO: 359 - DNA, 389 bp, Homo Sapiens
  Umbilical cord
  sig_peptide 36..98: Von Heijne matrix
  score 9.30
  misc_feature complement(2..198): seq VLPVILLLLGAHP/SP; blastn; identity 93; region 2..198
  id N27605
  misc_feature complement(2..69): est; blastn; identity 95; region 1..68
  id N78549
  unsure 36: est
  position 36 of amino acid sequence
  unsure 60: Xaa = Ile,Lys,Met,Asn,Thr; position 60 of amino acid sequence; Xaa = Ile,Thr
aaaatgctttcggtaggcactccamggctgtraagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaahkatcctcttcagaaataccactatcttcctgaagtttgatggagaaccttgtgacctgtctttgaatataaymtggtatctgaaaagcgctgattgttacaatgaaatctataacttcaaggcagaagaagtagagttgtatttggaaaaacttaaggaaaaaagaggcttgtctgggaaatgg

SEQ ID NO: 360 - DNA, 304 bp, Homo Sapiens
  Substantia nigra
  sig_peptide 212..268: Von Heijne matrix
  score 9.30
  misc_feature 31..297: seq LLWLALACSPVHT/XL; blastn; identity 96; region 1..267
  id HSC1WH101
  misc_feature 134..297: est; blastn; identity 97; region 41..204
  id R12437
  misc_feature 95..136: est; blastn; identity 100; region 1..42
  id R12437
  misc_feature 95..297: est; blastn; identity 98; region 1..203
  id R13448
  misc_feature 244..297: est; blastn; identity 92; region 82..135
  id T69236
  misc_feature 197..244: est; blastn; identity 100; region 36..83
  id T69236
  est
  misc_feature 72,93: n=a, g, c or t
  unsure 1: position 1 of amino acid sequence
  unsure 8: Xaa = Ser,Thr; position 8 of amino acid sequence; Xaa = Ala,Gly,Pro,Arg,Thr
atccggcgcgctggagcgttttccggccgtgcgtttgtggccgtccggcctccctgacatgcagatttccanssagaagacagagaaggagcnagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgttcacactascctgtcaaagtcagatgccvsaaaaccgcctagg

SEQ ID NO: 361 - DNA, 216 bp, Homo Sapiens
  Muscle
  sig_peptide 37..84: Von Heijne matrix
  score 9.30
  misc_feature 43..162: seq LFVAIFAVPLILG/QE; blastn; identity 99; region 29..148
  id T98462
  misc_feature 179..216: est; blastn; identity 92; region 165..202
  id T98462
  misc_feature 17..162: est; blastn; identity 98; region 110..255
  id T82829
  misc_feature 16..162: est; blastn; identity 99; region 1..147
  id AA027213
  misc_feature 32..162: est; blastn; identity 99; region 2..132
  id AA095731
  misc_feature 179..216: est; blastn; identity 92; region 149..186
  id AA095731
  misc_feature complement(85..162): est; blastn; identity 97; region 358..435
  id AA027214
  misc_feature complement(16..87): est; blastn; identity 91; region 434..505
  id AA027214
  unsure 29: est
  position 29 of amino acid sequence
  unsure 32: Xaa = Ala,Thr
  position 32 of amino acid sequence
  unsure 33: Xaa = Pro,Thr
  position 33 of amino acid sequence
  unsure 39: Xaa = Asp,Asn; position 39 of amino acid sequence; Xaa = Ala,Ser
cttttttactttcacagcaatagtgcagaatccagaatggatgtcctctttgtagccatctttgctgtgccacttatcctgggacaagaatatgaggatgaagaaagactgggagaggatgaatattatcaggtggtctattattatacagtcacccccattatgatgrcyttagggmcrratttcaccattgattackccatatttgagtcagag

SEQ ID NO: 362 - DNA, 343 bp, Homo Sapiens
  Substantia nigra
  sig_peptide 20..82: Von Heijne matrix
  score 9.30
  misc_feature complement(3..181): seq VLPVILLLLGAHP/SP; blastn; identity 93; region 3..181
  id N27605
  misc_feature complement(3..53): est; blastn; identity 100; region 1..51; id N78549; est
aaactccacggctgtgaagatggcggctgctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaactt

SEQ ID NO: 363 - DNA, 258 bp, Homo Sapiens
  brain
  sig_peptide 94..150: Von Heijne matrix
  score 9.20
  misc_feature 48..243: seq LLXLALACSPVHT/TL; blastn; identity 98; region 72..267
  id R13448
  misc_feature 126..255: est; blastn; identity 100; region 82..211
  id T69236
  misc_feature 79..126: est; blastn; identity 97; region 36..83
  id T69236
  misc_feature 48..244: est; blastn; identity 98; region 73..269
  id R12437
  misc_feature 48..211: est; blastn; identity 99; region 136..299
  id HSC1WH101
  misc_feature 17..50: est; blastn; identity 94; region 1..34
  id HSC1WH101
  unsure -11: est; position -11 of amino acid sequence; Xaa = Leu,Trp
agcgttttchggccgtgcgtttgtggccgtccggcctccctgacatgcagccctctggaccccgaggttggaccctactgtgacacacctaccatgcggacactcttcaacctcctctkgcttgccctggcctgcagccctgttcacactaccctgtcaaagtcagatgccaaaaaagccgcctcaaagacgctgctggagaagagtcagttttcagataagccggtgcaagaccggggtttggtggtgacggacggg

SEQ ID NO: 364 - DNA, 271 bp, Homo Sapiens
  Cancerous prostate
  sig_peptide 62..181: Von Heijne matrix
  score 9.00
  misc_feature 1..191: seq LLCLLHFSIVSVA/AX; blastn; identity 97; region 8..198
  id R72126
  misc_feature 2..169: est; blastn; identity 100; region 8..175
  id W60037
  misc_feature 18..191: est; blastn; identity 98; region 1..174
  id W24729
  misc_feature 228..271: est; blastn; identity 93; region 209..252
  id W24729
  misc_feature 18..191: est; blastn; identity 98; region 1..174
  id R74426
  misc_feature 228..271: est; blastn; identity 93; region 209..252
  id R74426
  misc_feature 18..191: est; blastn; identity 98; region 1..174
  id H42031
  misc_feature 228..271: est; blastn; identity 93; region 209..252
  id H42031
  unsure 2: est
  position 2 of amino acid sequence
  unsure 5: Xaa = Asp,His
  position 5 of amino acid sequence
  unsure 6: Xaa = Pro,Ser
  position 6 of amino acid sequence
  unsure 7: Xaa = Cys,Phe,Gly,Val
  position 7 of amino acid sequence
  unsure 8: Xaa = Ala,Cys,Gly,Ser,Thr
  position 8 of amino acid sequence
  unsure 9,15: Xaa =  * ,Cys,Arg,Ser
  position 9, 15 of amino acid sequence
  unsure 11: Xaa = Phe,Leu; position 11 of amino acid sequence; Xaa = Ala,Glu
actgaagtgggcaaaatccccgagaagcagcggtgtccccagcctctcactcggagccgatatggggagtaaagtggcggacctgctgtactggaaggacacgaggacgtcaggagtggtcttcacaggcctgatggtctccctcctctgcctcctgcactttagcatcgtgtccgtggccgcgsactttggsyckkktdsywgmytkggggmacaatcctctytcagggtttacgcaaagtgctgcaggccgtgcaccggggggatggag

SEQ ID NO: 365 - DNA, 234 bp, Homo Sapiens
  Hypertrophic prostate
  sig_peptide 28..114: Von Heijne matrix
  score 8.90
  misc_feature 1..101: seq ALLIVCDVPSASA/QR; blastn; identity 100; region 14..114
  id N87112
  misc_feature 99..164: est; blastn; identity 98; region 111..176
  id N87112
  misc_feature 163..229: est; blastn; identity 94; region 174..240
  id N87112
  misc_feature 35..229: est; blastn; identity 97; region 1..195
  id AA206940
  misc_feature 35..229: est; blastn; identity 97; region 1..195
  id AA186993
  misc_feature 37..229: est; blastn; identity 98; region 1..193
  id T68050
  misc_feature 32..178: est; blastn; identity 95; region 1..147
  id AA157180
  misc_feature 175..231: est; blastn; identity 91; region 146..202; id AA157180; est
tcacttatagaagggagaggagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaagccccacatg

SEQ ID NO: 366 - DNA, 440 bp, Homo Sapiens
  Umbilical cord
  sig_peptide 30..86: Von Heijne matrix
  score 8.80
  misc_feature 186..265: seq SAVLSGFVLGALA/FQ; blastn; identity 100; region 2..81
  id AA089592
  misc_feature 266..312: est; blastn; identity 95; region 81..127
  id AA089592
  misc_feature 385..415: est; blastn; identity 100; region 194..224
  id AA089592
  misc_feature complement(305..440): est; blastn; identity 94; region 211..346
  id R83736
  misc_feature complement(294..439): est; blastn; identity 95; region 202..347; id R83667; est
aactcttgtgtagcctgaggcggcggtasatggagggggagagtacgtcggcggtgctctcgggctttgtgctcggcgcactcgctttccagcacctcaacacggactcggacacggaaggttttcttcttggggaagtaaaaggtgaagccaagaacagcattactgattcccaaatggatgatgttgaagttgtttatacaattgacattcagaaatatattccatgctatcagctttttagcttttataattcttcaggcgaagtaaatgagcaagcactgaagaaaatattatcaaatgtcaaaaagaatgtggtaggttggtacaaattccgtcgtcattcagatcagatcatgacgtttagagagaggytgcttcacaaaaacttgcaggagcatttttcaaaccaagaccttgtttttctgctattaacacca

SEQ ID NO: 367 - DNA, 261 bp, Homo Sapiens
  Hypertrophic prostate
  sig_peptide 106..201: Von Heijne matrix
  score 8.80
  misc_feature 46..259: seq VPMLLLIVGGSFG/LR; blastn; identity 100; region 45..258
  id H81225
  misc_feature 2..39: est; blastn; identity 100; region 1..38
  id H81225
  misc_feature 44..259: est; blastn; identity 100; region 1..216
  id AA044118
  misc_feature 41..259: est; blastn; identity 98; region 7..225
  id W01412
  misc_feature 46..259: est; blastn; identity 100; region 13..226
  id W42797
  misc_feature 124..259: est; blastn; identity 99; region 95..230
  id R39635
  misc_feature 45..124: est; blastn; identity 98; region 15..94; id R39635; est
aaagtgagttaaggacgtactcgtcttggtgagagcgtgastgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcaaatccgatatgatgctgtgaagagtaaaatggatcctgagcgg

SEQ ID NO: 368 - DNA, 440 bp, Homo Sapiens
  Lymph ganglia
  sig_peptide 24..431: Von Heijne matrix
  score 8.70
  misc_feature 143..345: seq AVALSLFLGWLGA/DR; blastn; identity 97; region 113..315
  id AA143062
  misc_feature 335..442: est; blastn; identity 99; region 304..411
  id AA143062
  misc_feature 72..149: est; blastn; identity 97; region 43..120
  id AA143062
  misc_feature 72..345: est; blastn; identity 97; region 44..317
  id HUM172D06B
  misc_feature 372..442: est; blastn; identity 100; region 340..410
  id HUM172D06B
  misc_feature 35..73: est; blastn; identity 94; region 8..46
  id HUM172D06B
  misc_feature 153..442: est; blastn; identity 100; region 125..414
  id N47594
  misc_feature 77..147: est; blastn; identity 100; region 49..119
  id N47594
  misc_feature 72..412: est; blastn; identity 98; region 45..385
  id HUM159G08B
  misc_feature 27..73: est; blastn; identity 95; region 1..47
  id HUM159G08B
  misc_feature 143..367: est; blastn; identity 98; region 92..316
  id N34957
  misc_feature 80..147: est; blastn; identity 100; region 30..97
  id N34957
  misc_feature 362..429: est; blastn; identity 91; region 312..379
  id N34957
  unsure -131: est; position -131 of amino acid sequence; Xaa = Pro,Arg
aagagaaagtgtcggtctccaagatggcggccgcctggcsdtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattt

SEQ ID NO: 369 - DNA, 168 bp, Homo Sapiens
  Normal prostate
  sig_peptide 73..129: Von Heijne matrix
  score 8.60
  misc_feature 27..165: seq LLWLALACSPVHT/TL; blastn; identity 99; region 136..274
  id HSC1WH101
  misc_feature 27..165: est; blastn; identity 99; region 73..211
  id R12437
  misc_feature 27..165: est; blastn; identity 99; region 72..210
  id R13448
  misc_feature 105..165: est; blastn; identity 98; region 82..142
  id T69236
  misc_feature 58..105: est; blastn; identity 100; region 36..83
  id T69236
  est
  misc_feature 18: n=a, g, c or t
agtggccgtccggcctcnctgacatgcagccctctggaccccgaggttggaccctactgtgacacacctaccatgcggacactcttcaacctcctctggcttgccctggcctgcagccctgttcacactaccctgtcaaagtcagatgccaaaaaagccacctcaggg

SEQ ID NO: 370 - DNA, 404 bp, Homo Sapiens
  Brain
  sig_peptide 132..257: Von Heijne matrix
  score 8.60
  misc_feature 5..385: seq ASLFLLLSLTVFS/IV; blastn; identity 100; region 1..381
  id C15922
  misc_feature 224..352: est; blastn; identity 99; region 200..328
  id AA100508
  misc_feature 121..225: est; blastn; identity 100; region 96..200
  id AA100508
  misc_feature 26..115: est; blastn; identity 100; region 1..90
  id AA100508
  misc_feature 21..353: est; blastn; identity 98; region 89..421
  id W27023
  misc_feature 353..394: est; blastn; identity 97; region 422..463
  id W27023
  misc_feature 121..290: est; blastn; identity 100; region 76..245
  id W68781
  misc_feature 312..406: est; blastn; identity 97; region 267..361
  id W68781
  misc_feature 46..114: est; blastn; identity 100; region 1..69
  id W68781
  misc_feature 176..406: est; blastn; identity 99; region 101..331
  id T80234
  misc_feature 138..178: est; blastn; identity 100; region 62..102
  id T80234
  misc_feature 79..115: est; blastn; identity 100; region 1..37; id T80234; est
aagaggagactgcagacttcggttgaggaaacgggtatttcatgtctcagggagtaggtttgtgcagttacagcttttctgttggtatgcataattaataattggagctgcaaagcagatcgtgacaagagatggacggtcagaagaaaaattggaaggacaaggttgttgacctcctgtactggagagacattaagaagactggagtggtgtttggtgccagcctattcctgctgctttcattgacagtattcagcattgtgagcgtaacagcctacattgccttggccctgctctctgtgaccatcagctttaggatatacaagggtgtgatccaagctatccagaaatcagatgaaggccacccattcagggcatatctggaatctgaagttgctatatct

SEQ ID NO: 371 - DNA, 475 bp, Homo Sapiens
  Umbilical cord
  sig_peptide 41..94: Von Heijne matrix
  score 8.50
  misc_feature 439..475: seq LVLGLVLPLILWA/DR; blastn; identity 94; region 24..60
  id AA013254
  unsure 76: est
  position 76 of amino acid sequence
  unsure 124: Xaa = Ala,Pro; position 124 of amino acid sequence; Xaa = Leu,Val
aactttcccagtcctaggcggcggtcagatccttgcaagcatggtcgcgccggggcttgtactcgggctggtgctgccattaatcctgtgggccgacagaagtgcaggtattggttttcgctttgcttcatacatcaataatgatatggtgctgcagaaggagcctgctggggcagtgatatggggcttcggtacacctggagccacagtgaccgtgaccctgcgccaaggtcaggaaaccatcatgaagaaagtgaccagtgtgaaagctcactctgatacgtggatggtggtactggatcctatgaagcctggaggrsctttcgaagtgatggcacaacagactttggagaaaataaacttcaccctgagagttcatgacgtcctgtttggagatgtctggctctgtagtgggcagagtaacatgcagatgaccgcgcgggtcttcagatggcgtcatgtgktggggctttta

SEQ ID NO: 372 - DNA, 323 bp, Homo Sapiens
  Ovary
  sig_peptide 45..107: Von Heijne matrix
  score 8.50
  misc_feature 43..318: seq LLTIVGLILPTRG/QT; blastn; identity 99; region 82..357
  id AA075901
  misc_feature 22..318: est; blastn; identity 99; region 2..298
  id H25630
  misc_feature 23..318: est; blastn; identity 99; region 3..298
  id H43485
  misc_feature 34..318: est; blastn; identity 100; region 1..285
  id H80718
  misc_feature 43..318: est; blastn; identity 99; region 28..303; id AA044211; est
acctctctccacgaggctgccggcttaggacccccagctccgacatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacaccacgg

SEQ ID NO: 373 - DNA, 354 bp, Homo Sapiens
  Prostate
  sig_peptide 13..153: Von Heijne matrix
  score 8.30
  misc_feature 65..352: seq LALSSLLSLLLFA/GM; blastn; identity 99; region 43..330
  id W31335
  misc_feature 22..63: est; blastn; identity 95; region 1..42
  id W31335
  misc_feature 28..352: est; blastn; identity 99; region 2..326
  id AA094921
  misc_feature 23..345: est; blastn; identity 98; region 1..323
  id AA055130
  misc_feature 62..183: est; blastn; identity 98; region 60..181
  id R16450
  misc_feature 180..245: est; blastn; identity 96; region 179..244
  id R16450
  misc_feature 19..62: est; blastn; identity 97; region 18..61
  id R16450
  misc_feature 66..183: est; blastn; identity 98; region 75..192
  id H94808
  misc_feature 197..254: est; blastn; identity 98; region 208..265; id H94808; est
aagcgctgacgcatgcgcatagctaaccgcacccggttcagcttgcctttcttggccagaggcgccggttggactcacgggcggggcatgatggtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgccttcaataatctggagaatcttgtctttggcaaaggattccaagcaaagatcttccctgagattctcctgtgcctcctgttggctctctttgcatctggcccg

SEQ ID NO: 374 - DNA, 319 bp, Homo Sapiens
  Normal prostate
  sig_peptide 62..166: Von Heijne matrix
  score 8.30
  misc_feature 22..230: seq NLLLLHCVSRSHS/QN; blastn; identity 98; region 1..209
  id R54127
  misc_feature 221..317: est; blastn; identity 98; region 199..295
  id R54127
  misc_feature 24..317: est; blastn; identity 99; region 10..303
  id R60167
  misc_feature 26..230: est; blastn; identity 93; region 1..205
  id H29628
  misc_feature 211..317: est; blastn; identity 99; region 185..291
  id H29628
  misc_feature 113..317: est; blastn; identity 98; region 85..289
  id N40052
  misc_feature 28..116: est; blastn; identity 97; region 1..89
  id N40052
  misc_feature 24..230: est; blastn; identity 98; region 10..216
  id R34889
  misc_feature 221..279: est; blastn; identity 100; region 206..264
  id R34889
  unsure 38: est; position 38 of amino acid sequence; Xaa =  * ,Cys
atctgtgctgctggcctggggttgtggttgaggccgtgtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgmtcttacctacctgatgaatttatagaatgtgaagaccgg

SEQ ID NO: 375 - DNA, 453 bp, Homo Sapiens
  brain
  sig_peptide 79..237: Von Heijne matrix
  score 8.10
  misc_feature 26..259: seq IYALFLLVGVCVA/CV; blastn; identity 99; region 1..234
  id T59284
  misc_feature 286..342: est; blastn; identity 100; region 263..319
  id T59284
  misc_feature 340..387: est; blastn; identity 97; region 318..365
  id T59284
  misc_feature 256..292: est; blastn; identity 94; region 232..268
  id T59284
  misc_feature 66..356: est; blastn; identity 97; region 1..291
  id W52428
  misc_feature 361..453: est; blastn; identity 97; region 298..390
  id W52428
  est
  misc_feature 237: n=a, g, c or t
  unsure 47: position 47 of amino acid sequence; Xaa = Phe,Ile,Leu
aagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcntgtgtaatgttgataccaggaatggaagaacaactgaataagattcctggattttgtgagaatgagaaaggtgttgtcccttgtaacattttggttggctataaagctgtatatcgtttgtgctttggtttggctatghtctatcttcttctctctttactaatgatcaaagtgaagagtagcagtgatcctagagctgcagtgcacaatggattt

SEQ ID NO: 376 - DNA, 495 bp, Homo Sapiens
  Brain
  sig_peptide 31..201: Von Heijne matrix
  score 8.00
  misc_feature 61..243: seq IVRLVAFCPFASS/QV; blastn; identity 97; region 41..223
  id AA102323
  misc_feature 236..272: est; blastn; identity 100; region 217..253
  id AA102323
  misc_feature 314..349: est; blastn; identity 91; region 298..333
  id AA102323
  misc_feature 268..300: est; blastn; identity 93; region 250..282
  id AA102323
  misc_feature 268..434: est; blastn; identity 97; region 211..377
  id H30432
  misc_feature 147..218: est; blastn; identity 98; region 88..159
  id H30432
  misc_feature 209..271: est; blastn; identity 96; region 151..213
  id H30432
  misc_feature 250..434: est; blastn; identity 96; region 71..255
  id H08060
  misc_feature 61..113: est; blastn; identity 96; region 35..87
  id H08060
  misc_feature 449..478: est; blastn; identity 93; region 268..297
  id H08060
  misc_feature 77..165: est; blastn; identity 97; region 61..149
  id AA088762
  misc_feature 201..253: est; blastn; identity 94; region 185..237
  id AA088762
  misc_feature 19..64: est; blastn; identity 95; region 1..46
  id AA088762
  misc_feature 251..284: est; blastn; identity 91; region 236..269
  id AA088762
  misc_feature 126..252: est; blastn; identity 98; region 102..228
  id HSC0WG121
  misc_feature 61..127: est; blastn; identity 100; region 36..102
  id HSC0WG121
  est
  misc_feature 4,11: n=a, g, c or t
  unsure 67: position 67 of amino acid sequence
  unsure 83: Xaa = Gly,Arg; position 83 of amino acid sequence; Xaa = Gly,Val
aatngcgagcngaacccggcagctggcgccatggtgctgttgcacgtgctgtttgagcacgcggtcggctacgcgctgctggcgctgaaggaagtggaggagatcagtctgctgcagccgcaggtggaggagtccgtgctcaacctgggcaaattccacagcatcgttcgtctggtggccttttgtccctttgcctcatcccaggttgccttggaaaatgccaacgccgtgtctgaaggggttgttcatgaggacctccgcctgctcttggagacccacctgccgtccaaaaagaagaaagtactcttgggagttggggatcccaagattggtgccgcaatacaggaggagttagggtacaactgccagactggaggagtcatagctgagatcctgcgargagttcgtctgcacttccacaatctggtgaaagggtctgaccgatgtgktcagcttgtaaagcacagctggggctgggacacagctattcccatg

SEQ ID NO: 377 - DNA, 268 bp, Homo Sapiens
  Colon
  sig_peptide 83..223: Von Heijne matrix
  score 7.90
  misc_feature 19..262: seq LLLPRVLLTMASG/SP; blastn; identity 98; region 20..263
  id H52756
  misc_feature 1..186: est; blastn; identity 96; region 10..195
  id H85714
  misc_feature 172..262: est; blastn; identity 97; region 182..272
  id H85714
  misc_feature 9..262: est; blastn; identity 100; region 2..255
  id R78970
  misc_feature 7..186: est; blastn; identity 95; region 1..180
  id R64509
  misc_feature 172..262: est; blastn; identity 97; region 167..257
  id R64509
  misc_feature 14..228: est; blastn; identity 95; region 29..243; id T73900; est
gaagaggccgctcttcctggggttgtttctccgtgtgacgtgtggcctttgagatcaactctcctgtaccagcgtaggccgcatgagtggggggcgggctcccgcggtcctgctcggcggagtggcctctctgctcctgtcttttgtttggatgccggcgctgctgcctgtggcctcccgccttttgttgctaccccgagtcttgctgaccatggcctctggaagccctccgacccagccctcgccggcctcggattccggcatcggg

SEQ ID NO: 378 - DNA, 179 bp, Homo Sapiens
  Brain
  sig_peptide 54..131: Von Heijne matrix
  score 7.80
  misc_feature 14..177: seq LVGFILFLTRSRG/RA; blastn; identity 96; region 1..164; id T09311; est
atgagatcccggcctcagggtggacgcagtggttctgcactgaggccctcgtcatggtggcgcctgtgtggtacttggtagcggcggctctgctagtcggctttatcctcttcctgactcgcagccggggccgggcggcatcagccggccaagagccactgcacaatgaggagccgggg

SEQ ID NO: 379 - DNA, 430 bp, Homo Sapiens
  Brain
  sig_peptide 38..181: Von Heijne matrix
  score 7.60
  misc_feature 329..432: seq FLLVRKLPPLCHG/LP; blastn; identity 96; region 300..403
  id AA182502
  misc_feature 103..194: est; blastn; identity 97; region 70..161
  id AA182502
  misc_feature 185..278: est; blastn; identity 94; region 153..246
  id AA182502
  misc_feature 33..109: est; blastn; identity 96; region 1..77
  id AA182502
  misc_feature 275..326: est; blastn; identity 98; region 244..295
  id AA182502
  misc_feature 41..128: est; blastn; identity 100; region 1..88
  id AA088802
  misc_feature 275..356: est; blastn; identity 98; region 240..321
  id AA088802
  misc_feature 206..278: est; blastn; identity 98; region 170..242
  id AA088802
  misc_feature 348..412: est; blastn; identity 95; region 314..378
  id AA088802
  misc_feature 141..194: est; blastn; identity 94; region 103..156
  id AA088802
  misc_feature 103..273: est; blastn; identity 99; region 37..207
  id W52153
  misc_feature 323..432: est; blastn; identity 97; region 259..368
  id W52153
  misc_feature 272..326: est; blastn; identity 98; region 207..261
  id W52153
  misc_feature 66..109: est; blastn; identity 93; region 1..44
  id W52153
  unsure 5: est; position 5 of amino acid sequence; Xaa = Arg,Ser
acgacgccggcgagcagtggccgtkacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaamgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctt

SEQ ID NO: 380 - DNA, 452 bp, Homo Sapiens
  Testis
  sig_peptide 9..215: Von Heijne matrix
  score 7.60
  misc_feature 75..162: seq FLLVRKLPPLCHG/LP; blastn; identity 100; region 1..88
  id AA088802
  misc_feature 309..390: est; blastn; identity 97; region 240..321
  id AA088802
  misc_feature 240..312: est; blastn; identity 98; region 170..242
  id AA088802
  misc_feature 382..446: est; blastn; identity 95; region 314..378
  id AA088802
  misc_feature 175..228: est; blastn; identity 96; region 103..156
  id AA088802
  misc_feature 137..307: est; blastn; identity 99; region 37..207
  id W52153
  misc_feature 357..453: est; blastn; identity 97; region 259..355
  id W52153
  misc_feature 306..360: est; blastn; identity 96; region 207..261
  id W52153
  misc_feature 100..143: est; blastn; identity 93; region 1..44
  id W52153
  misc_feature 70..322: est; blastn; identity 100; region 48..300
  id H15999
  misc_feature 22..63: est; blastn; identity 90; region 1..42
  id H15999
  unsure -56: est
  position -56 of amino acid sequence
  unsure -55: Xaa = Ala,Pro
  position -55 of amino acid sequence
  unsure -50: Xaa = Leu,Val; position -50 of amino acid sequence; Xaa = Asp,Glu,Gly,Val
aagtcgttatggtgggggaggcggggcgagacctacgacgccggcgascwktggccgttacggccgddaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatatagccaacattttcatgtttagtaaagtggccaacacaattcttttcttccgcttggatattcgcatgggcctactttacatcacactctgcatagtgttcctgatgacgtgc

SEQ ID NO: 381 - DNA, 437 bp, Homo Sapiens
  Brain
  sig_peptide 21..164: Von Heijne matrix
  score 7.60
  misc_feature 236..362: seq LLMLLLFLSELQY/YL; blastn; identity 100; region 178..304
  id W69812
  misc_feature 61..184: est; blastn; identity 100; region 1..124
  id W69812
  misc_feature 359..423: est; blastn; identity 100; region 302..366
  id W69812
  misc_feature 184..236: est; blastn; identity 100; region 125..177
  id W69812
  misc_feature 35..395: est; blastn; identity 99; region 1..361
  id T09075
  misc_feature 79..386: est; blastn; identity 100; region 1..308
  id W45253
  misc_feature 386..438: est; blastn; identity 98; region 309..361
  id W45253
  misc_feature 18..417: est; blastn; identity 92; region 1..400
  id AA105440
  misc_feature 2..288: est; blastn; identity 99; region 9..295; id H42261; est
accctttccggmmggtccccatggaggcgctggggaagctgaagcagttcgatgcctaccccaagactttggaggacttccgggtcaagacctgcgggggcgccaccgtgaccattgtcagtggccttctcatgctgctactgttcctgtccgagctgcagtattacctcaccacggaggtgcatcctgagctctacgtggacaagtcgcggggagataaactgaagatcaacatcgatgtactttttccgcacatgccttgtgcctatctgagtattgatgccatggatgtggccggagaacagcagctggatgtggaacacaacctgttcaagcaacgactagataaagatggcatccccgtgagctcagaggctgagcggcatgagcttgggaaagtcgaggtgacggtgtttgaccctgactccctggacccg

SEQ ID NO: 382 - DNA, 444 bp, Homo Sapiens
  Substantia nigra
  sig_peptide 13..156: Von Heijne matrix
  score 7.60
  misc_feature 78..169: seq FLLVRKLPPLCHG/LP; blastn; identity 98; region 70..161
  id AA182502
  misc_feature 304..396: est; blastn; identity 96; region 300..392
  id AA182502
  misc_feature 160..253: est; blastn; identity 93; region 153..246
  id AA182502
  misc_feature 8..84: est; blastn; identity 96; region 1..77
  id AA182502
  misc_feature 250..301: est; blastn; identity 98; region 244..295
  id AA182502
  misc_feature 78..248: est; blastn; identity 98; region 37..207
  id W52153
  misc_feature 298..396: est; blastn; identity 96; region 259..357
  id W52153
  misc_feature 247..301: est; blastn; identity 98; region 207..261
  id W52153
  misc_feature 41..84: est; blastn; identity 93; region 1..44
  id W52153
  misc_feature 409..445: est; blastn; identity 94; region 370..406
  id W52153
  misc_feature 16..103: est; blastn; identity 100; region 1..88
  id AA088802
  misc_feature 250..331: est; blastn; identity 98; region 240..321
  id AA088802
  misc_feature 181..253: est; blastn; identity 95; region 170..242
  id AA088802
  misc_feature 323..387: est; blastn; identity 93; region 314..378
  id AA088802
  misc_feature 116..169: est; blastn; identity 96; region 103..156
  id AA088802
  misc_feature 409..446: est; blastn; identity 92; region 444..481
  id W57342
  est
  misc_feature 185..186: n=a, g, c or t
  unsure 10: position 10 of amino acid sequence
  unsure 68: Xaa = His,Leu,Pro,Gln,Arg
  position 68 of amino acid sequence
  unsure 91: Xaa = Cys,Tyr; position 91 of amino acid sequence; Xaa = Lys,Arg,Thr
acggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaaccnntgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttrcatcacactctgcatagtgttcctgatgacgtgcaaaccccccctatatatgggccctgagtatatcavgtacttcaatgataaa

SEQ ID NO: 383 - DNA, 405 bp, Homo Sapiens
  Testis
  sig_peptide 55..111: Von Heijne matrix
  score 7.40
  misc_feature 22..293: seq PMLLRALAQAARA/GP; blastn; identity 99; region 1..272
  id C18312
  misc_feature 281..407: est; blastn; identity 96; region 259..385
  id C18312
  misc_feature 87..293: est; blastn; identity 96; region 59..265
  id R99140
  misc_feature 281..368: est; blastn; identity 90; region 252..339
  id R99140
  misc_feature 49..95: est; blastn; identity 100; region 22..68
  id R99140
  misc_feature 133..293: est; blastn; identity 99; region 92..252
  id T78951
  misc_feature 281..356: est; blastn; identity 92; region 239..314
  id T78951
  misc_feature 64..94: est; blastn; identity 100; region 25..55
  id T78951
  misc_feature 102..132: est; blastn; identity 100; region 62..92
  id T78951
  misc_feature 133..294: est; blastn; identity 96; region 144..305
  id W69247
  misc_feature 280..332: est; blastn; identity 94; region 292..344
  id W69247
  misc_feature 49..95: est; blastn; identity 100; region 62..108
  id W69247
  misc_feature 97..308: est; blastn; identity 98; region 69..280
  id H75891
  misc_feature 27..95: est; blastn; identity 95; region 1..69
  id H75891
  misc_feature 306..335: est; blastn; identity 93; region 280..309; id H75891; est
agcctcccgattgactggcctgcttggcaabgcaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccggccaccatcaactacccgttcgagaagggcccgctgagccctcgcttccgtggggagcatgcgctgcgccggtacccatccggggaggagcgttgcattgcctgcaagctctgc

SEQ ID NO: 384 - DNA, 415 bp, Homo Sapiens
  Brain
  sig_peptide 23..79: Von Heijne matrix
  score 7.40
  misc_feature 2..261: seq PMLLRALAQAARA/GP; blastn; identity 99; region 13..272
  id C18312
  misc_feature 249..415: est; blastn; identity 96; region 259..425
  id C18312
  misc_feature 55..261: est; blastn; identity 96; region 59..265
  id R99140
  misc_feature 17..63: est; blastn; identity 100; region 22..68
  id R99140
  misc_feature 101..261: est; blastn; identity 99; region 92..252
  id T78951
  misc_feature 249..324: est; blastn; identity 90; region 239..314
  id T78951
  misc_feature 70..100: est; blastn; identity 100; region 62..92
  id T78951
  misc_feature 32..62: est; blastn; identity 100; region 25..55
  id T78951
  misc_feature 15..291: est; blastn; identity 99; region 1..277
  id C16677
  misc_feature 65..276: est; blastn; identity 98; region 69..280
  id H75891
  misc_feature 2..63: est; blastn; identity 96; region 8..69
  id H75891
  misc_feature 274..303: est; blastn; identity 93; region 280..309
  id H75891
  est
  misc_feature 260: n=a, g, c or t
  unsure 61: position 61 of amino acid sequence; Xaa = Ala,Pro,Ser,Thr
aaagtagcggcggcgcttcaagatgcgctgcctgaccacgcctatgctgctgcgggccctggcccaggctgcacgtgcaggacctcctggtggccggagcctccacagcagtgcagtggcagccacctacaagtatgtgaacatgcaggatcccgagatggacatgaagtcagtgactgaccgggcagcccgcaccctgctgtggactgagctcttccgaggcctgggcatgaccctgagctacctgttccgggaaccgnccaccatcaactacccgttcgagaagggcccgctgagccctcgcttccgtggggagcatgcgctgcgccggtacccatccggggaggagcgttgcattgcctgcaagctctgcgaggccatctgccccgcccaggccatcaccatcgaggctgag

SEQ ID NO: 385 - DNA, 406 bp, Homo Sapiens
  Substantia nigra
  sig_peptide 59..121: Von Heijne matrix
  score 7.40
  misc_feature 1..348: seq ILPLLFGCLGVFG/LF; blastn; identity 99; region 2..349
  id N40260
  misc_feature 349..400: est; blastn; identity 92; region 351..402
  id N40260
  misc_feature 53..400: est; blastn; identity 97; region 22..369
  id W37568
  misc_feature 53..336: est; blastn; identity 99; region 14..297
  id AA135041
  misc_feature 335..396: est; blastn; identity 90; region 297..358
  id AA135041
  misc_feature 114..300: est; blastn; identity 100; region 74..260
  id W00732
  misc_feature 302..386: est; blastn; identity 94; region 263..347
  id W00732
  misc_feature 1..284: est; blastn; identity 97; region 16..299
  id W07706
  misc_feature 285..323: est; blastn; identity 100; region 301..339
  id W07706
  est
  misc_feature 352,355: n=a, g, c or t
  unsure 77: position 77 of amino acid sequence
  unsure 78: Xaa = Leu,Arg; position 78 of amino acid sequence; Xaa = Phe,Leu
gaagttgcttgactatggtctctccggctaccaggaagagtctgccgaagtgaaggccatggacttcatcacctccacagccatcctgcccctgctgttcggctgcctgggcgtcttcggcctcttccggctgctgcagtgggtgcgcgggaaggcctacctgcggaatgctgtggtggtgatcacaggcgccacctcagggctgggcaaagaatgtgcaaaagtcttctatgctgcgggtgctaaactggtgctctgtggccggaatggtggggccctagaagagctcatcagagaactcaccgcttctcatgccaccaaggtgcagacacacaagccttacttggtacknttngacctcacagactctggggccatagttgcagcagcagctgagatctgcagt

SEQ ID NO: 386 - DNA, 302 bp, Homo Sapiens
  Lymph ganglia
  sig_peptide 162..248: Von Heijne matrix
  score 7.40
  misc_feature 18..298: seq LLLVTWVFTPVTT/EI; blastn; identity 98; region 1..281
  id C17369
  misc_feature 18..298: est; blastn; identity 98; region 1..281
  id HUM522E11B
  misc_feature 42..298: est; blastn; identity 98; region 1..257
  id HUM503D01B
  misc_feature 82..298: est; blastn; identity 95; region 46..262
  id N30487
  misc_feature 35..70: est; blastn; identity 100; region 1..36
  id N30487
  misc_feature 19..252: est; blastn; identity 97; region 1..234
  id C17067
  unsure 9: est; position 9 of amino acid sequence; Xaa = Gly,Arg,Ser
agtgttcgccgctggagcccgggtcgagaggacgaggtgccgctgcctggagaatcctccgctgccgtcggctcccggagcccagccctttcctaacccaacccaacctagcccagtcccagccgmcagmgcctgtccctrtcacggaccccagcgttaccatgcatcctgccgtcttcctatccttacccgacctcagatgctcccttctgctcctggtaacttgggtttttactcctgtaacaactgaaataacaagtcttgatacagagvgtatagatgaaattttaaacaatgcattg

SEQ ID NO: 387 - DNA, 264 bp, Homo Sapiens
  Brain
  sig_peptide 76..135: Von Heijne matrix
  score 7.40
  misc_feature 76..259: seq LVFCVGLLTMAKA/ES; blastn; identity 97.3000030517578; region 1..184
  id HSU72245
  misc_feature 63..168: vrt; blastn; identity 100; region 73..178
  id W25639
  misc_feature 168..259: est; blastn; identity 100; region 179..270
  id W25639
  misc_feature 27..71: est; blastn; identity 91; region 38..82
  id W25639
  misc_feature 12..259: est; blastn; identity 95; region 11..258
  id R72515
  misc_feature 32..259: est; blastn; identity 100; region 1..228
  id AA040016
  misc_feature 37..259: est; blastn; identity 100; region 1..223
  id T84313
  misc_feature 70..227: est; blastn; identity 100; region 129..286
  id H57207
  misc_feature 225..259: est; blastn; identity 100; region 285..319; id H57207; est
aaagtgctcagcccccggggsacagcaggacgtttgggggccttctttcagcaggggacagcccgattggggacaatggcgtctcttggccacatcttggttttctgtgtgggtctcctcaccatggccaaggcagaaagtccaaaggaacacgacccgttcacttacgactaccagtccctgcagatcggaggcctcgtcatcgccgggatcctcttcatcctgggcatcctcatcgtgctgagcagaagatgccggtttcgg

SEQ ID NO: 388 - DNA, 443 bp, Homo Sapiens
  Spleen
  sig_peptide 30..98: Von Heijne matrix
  score 7.30
  misc_feature 1..444: seq ALSLLLVSGSLLP/GP; blastn; identity 91.9000015258789; region 164..604
  id RNGP55
  misc_feature 104..444: vrt; blastn; identity 90.5999984741211; region 567..901
  id RNGP56
  misc_feature 3..444: vrt; blastn; identity 91.4000015258789; region 1..439
  id D50463
  misc_feature 205..298: vrt; blastn; identity 100; region 300..393
  id AA173361
  misc_feature 120..205: est; blastn; identity 100; region 214..299
  id AA173361
  misc_feature 1..62: est; blastn; identity 100; region 95..156
  id AA173361
  misc_feature 56..119: est; blastn; identity 95; region 149..212
  id AA173361
  misc_feature 297..340: est; blastn; identity 97; region 393..436
  id AA173361
  misc_feature 19..339: est; blastn; identity 100; region 1..321
  id R14826
  misc_feature 345..377: est; blastn; identity 93; region 330..362
  id R14826
  misc_feature 169..444: est; blastn; identity 92; region 133..408
  id W75505
  misc_feature 34..171: est; blastn; identity 90; region 1..138
  id W75505
  misc_feature 59..246: est; blastn; identity 95; region 165..352
  id AA206770
  misc_feature 284..351: est; blastn; identity 95; region 393..460
  id AA206770
  misc_feature 1..69: est; blastn; identity 91; region 105..173
  id AA206770
  misc_feature 243..286: est; blastn; identity 97; region 351..394
  id AA206770
  misc_feature 169..415: est; blastn; identity 93; region 133..379
  id W64115
  misc_feature 34..171: est; blastn; identity 90; region 1..138
  id W64115
  unsure 108: est; position 108 of amino acid sequence; Xaa =  * ,Glu,Lys
attcgctgttgggtcttctgctagggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccctgttctccctgtcaccctgcagtgtaacctcacctccagctctcacacccttacatacagctactggacaaagaatggggtggaactgagtgccactcgtaagaatgccagcaacatggagtacaggatcaataagccgagagctgaggattcaggcgaataccactgcgtatatcactttgtcagcgctcctaaagcaaacgccaccattgaagtgaaagccgctcctgacatcactggccataaacggagtdagaacaagaatgaagggcaggat

SEQ ID NO: 389 - DNA, 424 bp, Homo Sapiens
  Lymph ganglia
  sig_peptide 137..244: Von Heijne matrix
  score 7.20
  misc_feature 14..143: seq IMLLSLAAFSVIS/VV; blastn; identity 97; region 1..130
  id AA056148
  misc_feature 247..358: est; blastn; identity 99; region 369..480
  id AA056148
  misc_feature 140..251: est; blastn; identity 96; region 261..372
  id AA056148
  misc_feature 140..226: est; blastn; identity 100; region 227..313
  id AA134519
  misc_feature 73..143: est; blastn; identity 90; region 24..94
  id AA134519
  misc_feature 216..271: est; blastn; identity 91; region 304..359
  id AA134519
  misc_feature 294..342: est; blastn; identity 91; region 384..432
  id AA134519
  misc_feature 140..426: est; blastn; identity 99; region 6..292
  id HUM149F06B
  misc_feature 150..426: est; blastn; identity 99; region 55..331
  id AA187561
  misc_feature 140..423: est; blastn; identity 92; region 77..360; id W51338; est
agtctgtcggastctgtcctcggagcaggcggagtaaagggacttgagcgagccagttgccggattattctatttcccctccctctctsccgccccgtatctcttttcacccttctcccaccctcgctcgcgtrscatggcggtgcacgatctgattttctggagagatgtgaagaagactgggtttgtctttggcaccacgctgatcatgctgctttccctggcagctttcagtgtcatcagtgtggtttcttacctcatcctggctcttctctctgtcaccatcagcttcaggatctacaagtccgtcatccaagctgtacagaagtcagaagaaggccatccattcaaagcctacctggacgtagacattactctgtcctcagaagctttccataattacatgaatgctgcsatggtgcac

SEQ ID NO: 390 - DNA, 304 bp, Homo Sapiens
  Lymph ganglia
  sig_peptide 35..130: Von Heijne matrix
  score 7.10
  misc_feature 194..260: seq LLWTLLLFAAPFG/LL; blastn; identity 94; region 171..237
  id AA213022
  unsure -31: est
  position -31 of amino acid sequence
  unsure -24: Xaa = His,Arg; position -24 of amino acid sequence; Xaa =  * ,Trp
ctggcacctcttccgtcggctgaattgcggccgtatgcrcggctctgtggagtgcacctrgggttgggggcactgtgcccccagccccctgctcctttggactctacttctgtttgcagccccatttggcctgctgggggagaagacccgccaggtgtctctggaggtcatccctaactggctgggccccctgcagaacctgcttcatatacgggcagtgggcaccaattccacactgcactatgtgtggagcagcctggggcctctggcagtggtaatggtggccaccaacaccccccccggg

SEQ ID NO: 391 - DNA, 427 bp, Homo Sapiens
  Normal prostate
  sig_peptide 137..223: Von Heijne matrix
  score 7.10
  misc_feature 47..331: seq LIFLCGAALLAVG/IW; blastn; identity 100; region 30..314
  id AA100852
  misc_feature 330..429: est; blastn; identity 96; region 314..413
  id AA100852
  misc_feature 47..331: est; blastn; identity 99; region 30..314
  id AA161042
  misc_feature 338..422: est; blastn; identity 95; region 323..407
  id AA161042
  misc_feature 23..335: est; blastn; identity 99; region 1..313
  id H64488
  misc_feature 141..366: est; blastn; identity 99; region 129..354
  id AA088770
  misc_feature 32..121: est; blastn; identity 98; region 17..106
  id AA088770
  misc_feature 116..317: est; blastn; identity 96; region 134..335
  id AA146605
  misc_feature 317..378: est; blastn; identity 95; region 336..397
  id AA146605
  unsure 47: est
  position 47 of amino acid sequence
  unsure 51: Xaa = Asn,Ser,Thr,Tyr
  position 51 of amino acid sequence
  unsure 53: Xaa = Ala,Thr; position 53 of amino acid sequence; Xaa = Asn,Ser
aagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgcwmtggtgctaagrctgagarcaagtgtgccctcgtgacgttcttcttcatcctcctcctcatcttc

SEQ ID NO: 392 - DNA, 375 bp, Homo Sapiens
  Testis
  sig_peptide 16..111: Von Heijne matrix
  score 7.10
  misc_feature 241..334: seq LLWTLLLFAAPFG/LL; blastn; identity 95; region 18..111
  id N28008
  misc_feature 332..376: est; blastn; identity 97; region 108..152
  id N28008
  unsure -22: est
  position -22 of amino acid sequence
  unsure 29: Xaa = Ser,Trp; position 29 of amino acid sequence; Xaa = Ala,Pro,Ser
aagaattgcggccgtatgcgcggctctgtggagtgcacctggggttsggggcactgtgcccccagccccctgctcctttggactctacttctgtttgcagccccatttggcctgctgggggagaagacccaccaggtgtctctggaggtcatccctaactggctgggccccctgcagaacctgcttcatatacggbcagtgggcaccaattccacactgcactatgtgtggagcagcctggggcctctggcagtggtaatggtggccaccaacaccccccacagcaccctgagcgtcaactggagcctcctgctatcccctgagcccgatgggggcctgatggtgctccctaaggacagcattcagttttcttct

SEQ ID NO: 393 - DNA, 235 bp, Homo Sapiens
  Lymphocytes
  sig_peptide 38..82: Von Heijne matrix
  score 7.00
  misc_feature 164..234: seq LRLLKLAATSASA/RV; blastn; identity 98; region 163..233
  id AA113990
  misc_feature 41..98: est; blastn; identity 94; region 46..103
  id AA113990
  misc_feature 2..44: est; blastn; identity 95; region 8..50
  id AA113990
  misc_feature 111..140: est; blastn; identity 96; region 113..142
  id AA113990
  misc_feature 103..234: est; blastn; identity 97; region 71..202
  id R11825
  misc_feature 31..98: est; blastn; identity 94; region 1..68
  id R11825
  misc_feature 112..234: est; blastn; identity 100; region 83..205
  id H08475
  misc_feature 27..98: est; blastn; identity 97; region 1..72
  id H08475
  misc_feature 175..234: est; blastn; identity 95; region 142..201
  id C14102
  misc_feature 60..103: est; blastn; identity 97; region 25..68
  id C14102
  misc_feature 136..234: est; blastn; identity 98; region 1..99; id N87606; est
acccttgggtccttgatcctgagctgaccgggtagccatggccttgcggctcctgaagctggcagcgacgtccgcgtccgcccgggtcgtggcggcgggcgcccagcgcgtgagaggaattcatagcagtgtgcagtgcaagctgcgctatggaatgtggcatttcctacttggggataaagcaagcaaaagactgacagaacgcagcagagtgataactgtagatggcaatatg

SEQ ID NO: 394 - DNA, 409 bp, Homo Sapiens
  Cancerous prostate
  sig_peptide 62..256: Von Heijne matrix
  score 7.00
  misc_feature 65..409: seq IGHFLCLVILVYC/AE; blastn; identity 99; region 55..399
  id AA233701
  misc_feature 19..62: est; blastn; identity 93; region 7..50
  id AA233701
  misc_feature 148..409: est; blastn; identity 97; region 106..367
  id N39913
  misc_feature 44..151: est; blastn; identity 98; region 1..108
  id N39913
  misc_feature 42..169: est; blastn; identity 96; region 39..166
  id HUM527C01B
  misc_feature 169..284: est; blastn; identity 93; region 165..280
  id HUM527C01B
  misc_feature 5..42: est; blastn; identity 100; region 1..38
  id HUM527C01B
  misc_feature 19..118: est; blastn; identity 95; region 8..107; id AA280711; est
ctctgtggattctggccaggccgggttcggcggttgctgtgagagcgggcttcccaacaccatgccgtccgccttctctgtcagctctttccccgtcagcatcccagccgtgctcacgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgaaataccagtatttcgactccagggggatgttcatttctatagtattttcagccccactgctggtgaatgccatgatcattgtggttatgtgggtatggaagact

SEQ ID NO: 395 - DNA, 514 bp, Homo Sapiens
  Testis
  sig_peptide 26..487: Von Heijne matrix
  score 6.70
  misc_feature 220..364: seq ALGILVVAGCSFA/IR; blastn; identity 99; region 192..336
  id T53942
  misc_feature 88..223: est; blastn; identity 98; region 59..194
  id T53942
  misc_feature 31..88: est; blastn; identity 98; region 1..58
  id T53942
  misc_feature 371..409: est; blastn; identity 92; region 345..383
  id T53942
  misc_feature 32..349: est; blastn; identity 99; region 47..364
  id R55646
  misc_feature 2..35: est; blastn; identity 94; region 18..51
  id R55646
  misc_feature 32..223: est; blastn; identity 97; region 47..238
  id H21573
  misc_feature 220..325: est; blastn; identity 99; region 236..341
  id H21573
  misc_feature 2..35: est; blastn; identity 94; region 18..51
  id H21573
  misc_feature 44..296: est; blastn; identity 99; region 2..254
  id W47454
  misc_feature 305..344: est; blastn; identity 100; region 265..304
  id W47454
  misc_feature 395..426: est; blastn; identity 90; region 360..391
  id W47454
  misc_feature 39..223: est; blastn; identity 96; region 36..220
  id T71932
  misc_feature 220..272: est; blastn; identity 98; region 218..270
  id T71932
  misc_feature 4..37: est; blastn; identity 91; region 2..35
  id T71932
  unsure -126: est; position -126 of amino acid sequence; Xaa =  * ,Gly,Arg
aahcagacctcctcttggcttcgagatggctttgccacaccaagagcccaaacctggagacctgattgagattttccgccttggctatgagcactgggccctgtatatabgagatggctacgtgatccatctggctcctccaagtgagtaccccggggctggctcctccagtgtcttctcagtcctgagcaacagtgcagaggtgaaacgggagcgcctggaagatgtggtgggaggctgttgctatcgggtcaacaacagcttggaccatgagtaccaaccacggcccgtggaggtgatcatcagttctgcgaaggagatggttggtcagaagatgaagtacagtattgtgagcaggaactgtgagcactttgtcacccagctgagatatggcaagtcccgctgtaaacaggtggaaaaggccaaggttgaagtcggtgtggccacggcgcttggaatcctggttgttgctggatgctcttttgcgattaggagataccaaaaaaaagcgacc

SEQ ID NO: 396 - DNA, 387 bp, Homo Sapiens
  Hypertrophic prostate
  sig_peptide 13..222: Von Heijne matrix
  score 6.70
  misc_feature 35..153: seq LAFSLPALPLAEL/QP; blastn; identity 96; region 1..119
  id AA114211
  misc_feature 177..259: est; blastn; identity 97; region 143..225
  id AA114211
  misc_feature 65..153: est; blastn; identity 98; region 30..118
  id AA121286
  misc_feature 214..287: est; blastn; identity 98; region 177..250
  id AA121286
  misc_feature 276..340: est; blastn; identity 90; region 238..302
  id AA121286
  misc_feature 35..64: est; blastn; identity 100; region 1..30
  id AA121286
  unsure 43: est; position 43 of amino acid sequence; Xaa =  * ,Lys
agagtcgggaaaatggctgcgagtacctccatggtcccggtggctgtgacggcggcagtggcgcctgtcctgtccataaacagcgatttctcagatttgcgggaaattaaaaagcaactgctgcttattgcgggccttacccgggagcggggcctactacacagtagcaaatggtcggcggagttggctttctctctccctgcattgcctctggccgagctgcaaccgcctccgcctattacagaggaagatgcccaggatatggatgcctataccctggccaaggcctactttgacgttaaagagtatgatcgggcagcacatttcctgcatggctgcaatgcaagawaagcctattttctgtatatgtattccagatatctgtct

SEQ ID NO: 397 - DNA, 435 bp, Homo Sapiens
  Hypertrophic prostate
  sig_peptide 154..225: Von Heijne matrix
  score 6.60
  misc_feature 124..341: seq KMVHLLVLSGAWG/MQ; blastn; identity 99; region 116..333
  id H42954
  misc_feature 8..117: est; blastn; identity 99; region 2..111
  id H42954
  misc_feature 339..388: est; blastn; identity 92; region 332..381
  id H42954
  misc_feature 307..436: est; blastn; identity 97; region 275..404
  id N36051
  misc_feature 124..224: est; blastn; identity 98; region 94..194
  id N36051
  misc_feature 29..117: est; blastn; identity 98; region 1..89
  id N36051
  misc_feature 222..319: est; blastn; identity 91; region 191..288
  id N36051
  misc_feature 7..117: est; blastn; identity 95; region 1..111
  id N33866
  misc_feature 222..319: est; blastn; identity 91; region 197..294
  id N33866
  misc_feature 144..223: est; blastn; identity 100; region 120..199
  id N33866
  misc_feature 307..349: est; blastn; identity 97; region 281..323
  id N33866
  misc_feature 372..408: est; blastn; identity 94; region 346..382
  id N33866
  misc_feature 124..224: est; blastn; identity 98; region 65..165
  id N79656
  misc_feature 222..319: est; blastn; identity 90; region 162..259
  id N79656
  misc_feature 58..117: est; blastn; identity 95; region 1..60
  id N79656
  misc_feature 367..406: est; blastn; identity 97; region 307..346
  id N79656
  misc_feature 124..329: est; blastn; identity 99; region 86..291
  id HUM424A03B
  misc_feature 37..117: est; blastn; identity 97; region 1..81
  id HUM424A03B
  est
  misc_feature 125,358: n=a, g, c or t
  unsure 45: position 45 of amino acid sequence; Xaa = Phe,Ile,Leu,Val
aaaacccacgaggggacgcggccgaggagggtcgctgtccacccgggggcgtgggagtgaggtaccagattcagcccatttggccccgacgcctctgttctcggaatccgggtgctkgcggattnraggtcccggttcctaacggactgcaagatggaggaaggcgggaacctaggaggcctgattaagatggtccatctactggtcttgtcaggtgcctggggcatgcaaatgtgggtgaccttcgtctcaggcttcctgcttttccgaagccttccccgacataccttcggactagtgcagagcaaactcttccccttctacttccacatctccatgggctgtgccttcatcaayntctgcatcttggcttcacagcatgcttgggctcagctcacattctgggaggccagccagctttacctgctgttcctg

SEQ ID NO: 398 - DNA, 274 bp, Homo Sapiens
  kidney
  sig_peptide 14..256: Von Heijne matrix
  score 6.60
  misc_feature 173..269: seq LLLASGTTLFCTS/FY; blastn; identity 97; region 151..247
  id W04736
  misc_feature 17..49: est; blastn; identity 90; region 1..33
  id W04736
  misc_feature 103..259: est; blastn; identity 99; region 44..200
  id HUM054D06B
  misc_feature 64..110: est; blastn; identity 93; region 6..52
  id HUM054D06B
  misc_feature 64..276: est; blastn; identity 98; region 6..218
  id HUM065G09B
  misc_feature 103..276: est; blastn; identity 97; region 44..217
  id HUM062A01B
  misc_feature 63..110: est; blastn; identity 91; region 5..52
  id HUM062A01B
  misc_feature 66..191: est; blastn; identity 93; region 10..135
  id HUM048E08B
  misc_feature 179..276: est; blastn; identity 97; region 124..221
  id HUM048E08B
  unsure -51: est; position -51 of amino acid sequence; Xaa =  * ,Glu,Gln
atgttctacagctatggccgggccagctgcagctttccgccgcttgggcgccttgtccggagctgcggccttaggcttcgcttcctacggggcgcacggcgccbaattcccagatgcctacgggaaggagctgtttgacaaggccaacaaacaccacttcttacacagcctggccctgttaggggtgccccattgcagaaagccactctgggctgggttattgctagcttccggaacgaccttattctgcaccagcttttactaccaggctcag

SEQ ID NO: 399 - DNA, 182 bp, Homo Sapiens
  Testis
  sig_peptide 45..107: Von Heijne matrix
  score 6.50
  misc_feature 37..179: seq LLTLLLPPPPLYT/RH; blastn; identity 100; region 1..143
  id H06750
  misc_feature 66..179: est; blastn; identity 98; region 14..127
  id R09748
  misc_feature 106..181: est; blastn; identity 98; region 1..76; id AA025704; est
actcttccgggtcggcgctcctgcctccctgcagggagctgcttatgggacaccgcttcctgcgcggcctcttaacgctgctgctgccgccgccacccctgtatacccggcaccgcatgctcggtccagagtccgtcccgcccccaaaacgatcccgcagcaaactcatggcaccgccccgg

SEQ ID NO: 400 - DNA, 350 bp, Homo Sapiens
  kidney
  sig_peptide 111..170: Von Heijne matrix
  score 6.50
  misc_feature 80..352: seq ILFLLPSICSSNS/TG; blastn; identity 98; region 48..320
  id AA081335
  misc_feature 32..80: est; blastn; identity 93; region 1..49
  id AA081335
  misc_feature 205..352: est; blastn; identity 97; region 82..229
  id H88204
  misc_feature 121..218: est; blastn; identity 95; region 1..98
  id H88204
  misc_feature 193..352: est; blastn; identity 98; region 1..160
  id W31695
  unsure 17: est
  position 17 of amino acid sequence
  unsure 41: Xaa = Lys,Asn
  position 41 of amino acid sequence
  unsure 59: Xaa = His,Leu,Pro; position 59 of amino acid sequence; Xaa = Ala,Pro,Thr
aacattcactasrccttttccatttgctaataaggccctgccaggctgggagggaattgtccctgcctgcttctggagmamagaagatattgacaccatctacgggcaccatggaactgcttcaagtgaccattctttttcttctgcccagtatttgcagcagtaacagcacaggtgttttagaggcagctaataattcacttgttgttactacaacaaawccatctataacaacaccaaacacagaatcattacagaaaaatgttgtcacaccaacaactggaacaactchtaaaggaacaatcaccaatgaattacttaaaatgtctctgatgtcaacagctvctttt

SEQ ID NO: 401 - DNA, 462 bp, Homo Sapiens
  Lung (cells)
  sig_peptide 112..168: Von Heijne matrix
  score 6.30
  misc_feature 76..372: seq VLMRLVASAYSIA/QK; blastn; identity 99; region 33..329
  id H97426
  misc_feature 369..413: est; blastn; identity 93; region 327..371
  id H97426
  misc_feature 23..259: est; blastn; identity 100; region 2..238
  id W44834
  misc_feature 70..120: est; blastn; identity 96; region 4..54
  id R57989
  misc_feature 125..154: est; blastn; identity 93; region 62..91; id R57989; est
tttgacagtgccamagctcggtactggacacaacgagggacctgggtctacgataacgcgcttttgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggcccggaaattccccaaactcacaattataggggaagaggatctgccttctgaggaagtggatcaagagctgattgaagacagtcagtgggaagaaatactgaagcaaccatgcccatcgcagtacagtgctattaaagaagaagatctcgtggtctgggttgat

SEQ ID NO: 402 - DNA, 434 bp, Homo Sapiens
  Brain
  sig_peptide 84..128: Von Heijne matrix
  score 6.30
  misc_feature 26..292: seq SSCVLLTALVALA/AY; blastn; identity 98; region 1..267
  id HSU46357
  misc_feature 314..356: est; blastn; identity 93; region 291..333
  id HSU46357
  unsure 100: est; position 100 of amino acid sequence; Xaa = Gly,Arg
gcgggcagaaagttgccggaggtctccgggtggtatcgccctttcctctttgccagcccgctggcgagccgagccggggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggargaggctgg

SEQ ID NO: 403 - DNA, 268 bp, Homo Sapiens
  brain
  sig_peptide 47..124: Von Heijne matrix
  score 6.30
  misc_feature 10..266: seq GVGLVTLLGLAVG/SY; blastn; identity 100; region 1..257
  id H10448
  misc_feature 9..266: est; blastn; identity 96; region 1..258
  id HSC18H071
  misc_feature 21..266: est; blastn; identity 99; region 1..246
  id AA127134
  misc_feature 21..266: est; blastn; identity 98; region 1..246; id HUML13653; est
agggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacatg

SEQ ID NO: 404 - DNA, 315 bp, Homo Sapiens
  brain
  sig_peptide 52..258: Von Heijne matrix
  score 6.30
  misc_feature 58..96: seq ILLIVLFLDAVRE/VR; blastn; identity 100; region 53..91
  id N86348
  misc_feature 6..45: est; blastn; identity 95; region 1..40
  id N86348
  misc_feature 227..257: est; blastn; identity 96; region 211..241
  id N86348
  misc_feature 133..286: est; blastn; identity 99; region 1..154; id N88408; est
agcggrsagcgcagggagccaggcgggctgccggcgggtgtgaagaaaaaaatgacactccaatgggctgcagtggcaacctttctttatgccgaaataggactcattttaatcttctgcctaccttttattcctcctcagagatggcagaagattttttcatttaatgtctggggtaaaattgcaactttttggaacaaggctttccttaccattatcatcctattgattgttctatttctagatgctgtgagagaagtaaggaaatattcctcagttcataccattgagaagagctccaccagcagaccaagg

SEQ ID NO: 405 - DNA, 370 bp, Homo Sapiens
  kidney
  sig_peptide 89..343: Von Heijne matrix
  score 6.20
  misc_feature 17..138: seq FLDFCVYIPLSWG/FC; blastn; identity 98; region 1..122
  id HSC3DD031
  misc_feature 137..188: est; blastn; identity 100; region 120..171
  id HSC3DD031
  misc_feature 136..188: est; blastn; identity 98; region 83..135
  id T75196
  misc_feature 92..139: est; blastn; identity 97; region 38..85; id T75196; est
aagaagcctgtgtggccttcccggcggctgattcgagggcttgtttggtcagaaggggggcgtcagagaagctgccccttagccaaccatgccgtctgagggtcgctgctgggagaccttgaaggccctacgcagttccgacaaaggtcgcctttgctactaccgcgactggctgctgcggcgcgaggtgagcggtggccccggaggacgtaggcctttccggcccctcgcgaccgaaaccttctccctagccgttggcacgttctgctcccgggaacccgtgcagtctaacaacctgcatttatttcttgacttctgtgtgtacatccctctgtcctggggtttctgtcctcttcagcctattttagcg

SEQ ID NO: 406 - DNA, 383 bp, Homo Sapiens
  Umbilical cord
  sig_peptide 45..116: Von Heijne matrix
  score 6.20
  misc_feature 207..292: seq AILGSTWVALTTG/AL; blastn; identity 96; region 217..302
  id N92143
  misc_feature 308..381: est; blastn; identity 97; region 318..391
  id N92143
  misc_feature 98..169: est; blastn; identity 95; region 111..182
  id N92143
  misc_feature 38..104: est; blastn; identity 98; region 52..118
  id N92143
  misc_feature 12..41: est; blastn; identity 93; region 1..30
  id N92143
  misc_feature 119..293: est; blastn; identity 98; region 91..265
  id R97442
  misc_feature 29..125: est; blastn; identity 97; region 2..98
  id R97442
  misc_feature 293..381: est; blastn; identity 94; region 264..352
  id R97442
  misc_feature complement(254..378): est; blastn; identity 97; region 1..125
  id R97398
  misc_feature complement(146..253): est; blastn; identity 99; region 125..232
  id R97398
  misc_feature complement(97..147): est; blastn; identity 98; region 232..282
  id R97398
  misc_feature 119..305: est; blastn; identity 96; region 90..276
  id T80897
  misc_feature 29..125: est; blastn; identity 98; region 1..97
  id T80897
  misc_feature 26..125: est; blastn; identity 99; region 1..100
  id AA047755
  misc_feature 119..169: est; blastn; identity 94; region 93..143
  id AA047755
  misc_feature 246..289: est; blastn; identity 97; region 219..262
  id AA047755
  misc_feature 203..245: est; blastn; identity 90; region 175..217
  id AA047755
  misc_feature 169..203: est; blastn; identity 100; region 142..176
  id AA047755
  est
  misc_feature 307: n=a, g, c or t
  unsure 64: position 64 of amino acid sequence
  unsure 72: Xaa = Lys,Met,Arg,Thr; position 72 of amino acid sequence; Xaa = Ser,Thr
aatccgggccgcgcggggaaggggagacgtggggtagagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcangggctgcgcttctgacagcctaascccattcctgtgcggacagcccttcctcccatttcccattaaagagccaggg

SEQ ID NO: 407 - DNA, 276 bp, Homo Sapiens
  Normal prostate
  sig_peptide 112..174: Von Heijne matrix
  score 6.20
  misc_feature 44..205: seq FLVSNMLLAEAYG/SG; blastn; identity 97; region 28..189
  id AA122029
  misc_feature 15..44: est; blastn; identity 100; region 1..30
  id AA122029
  misc_feature 47..232: est; blastn; identity 95; region 26..211
  id HUML1833
  misc_feature 113..240: est; blastn; identity 99; region 1..128; id AA158721; est
aaacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcacagagcggg

SEQ ID NO: 408 - DNA, 442 bp, Homo Sapiens
  Brain
  sig_peptide 65..187: Von Heijne matrix
  score 6.20
  misc_feature 60..209: seq SVLVLLLLAVLYE/GI; blastn; identity 98; region 63..212
  id R85337
  misc_feature 204..336: est; blastn; identity 96; region 206..338
  id R85337
  misc_feature 393..444: est; blastn; identity 90; region 401..452
  id R85337
  misc_feature 28..58: est; blastn; identity 96; region 30..60
  id R85337
  misc_feature 47..366: est; blastn; identity 97; region 26..345
  id T86800
  misc_feature 373..403: est; blastn; identity 96; region 354..384
  id T86800
  misc_feature 46..378: est; blastn; identity 97; region 49..381; id H94753; est
agactcggagcgaggagacccgagcgagcagacgcggccctggcgcccgccctgcgcactcaccatggcgatgcatttcatcttctcagatacagcggtgcttctgtttcatttctggagtgtccacagtcctgctggcatggccctttcggtgttggtgctcctgcttctggctgtactgtatgaaggcatcaaggttggcaaagccaagctgctcaaccaggtactggtgaacctgccaacctccatcagccagcagaccatcgcagagacagacggggactctgcaggctcagattcattccctgttggcagaacccaccacaggtggtatttgtgtcactttggccagtctctaatccatgtcatccaggtggtcatcggctacttcatcatgctggccgtaatgtcctacaacacctggattttccttggtgtggtc

SEQ ID NO: 409 - DNA, 396 bp, Homo Sapiens
  Normal prostate
  sig_peptide 163..387: Von Heijne matrix
  score 6.20
  misc_feature 146..241: seq VVXXSVLXTTCXS/SQ; blastn; identity 95; region 183..278
  id T97803
  misc_feature 20..99: est; blastn; identity 96; region 5..84
  id N89398
  misc_feature complement(300..345): est; blastn; identity 95; region 273..318
  id T97702
  unsure -24: est
  position -24 of amino acid sequence
  unsure -14: Xaa = Cys,Ser
  position -14 of amino acid sequence
  unsure -11: Xaa = Lys,Thr
  position -11 of amino acid sequence
  unsure -10: Xaa =  * ,Leu,Trp
  position -10 of amino acid sequence
  unsure -6: Xaa = Pro,Thr
  position -6 of amino acid sequence
  unsure -2: Xaa = Met,Val; position -2 of amino acid sequence; Xaa = Asn,Thr
aggggcagcgcggggtcgccatggctgagctgcagcagctccgggtgcaggaggcggtggagtccatggtgaagagtctggaaagagagaacatccggaagatgcagggtctcatgttccggtgcagcgscagcytgttkgtvaaagrmcagcmaggcctccatgaagcaggtgcaccagtgcatcgagcgctgccatgtgcctctggctcaagcccaggctttggtcaccagtgagctggagaagttccaggaccgcctggcccggtgcaccatgcattgcaacgacaaagccaaagattcaatagatgctgggwgtaaggagcttcaggtgaagcagcagctgamagttgtgtkrmcaagtgtgttgrtgaccacatgcamctcatcccaacta

SEQ ID NO: 410 - DNA, 192 bp, Homo Sapiens
  Brain
  sig_peptide 76..156: Von Heijne matrix
  score 6.20
  misc_feature 24..193: seq LLAALMLVAMLQL/LY; blastn; identity 98; region 10..179
  id AA058587
  misc_feature 33..193: est; blastn; identity 97; region 1..161
  id R20025
  misc_feature 38..125: est; blastn; identity 98; region 2..89
  id R12128
  misc_feature 124..193: est; blastn; identity 97; region 87..156
  id R12128
  misc_feature 40..193: est; blastn; identity 94; region 2..155
  id H19999
  misc_feature 78..193: est; blastn; identity 97; region 1..116; id H83838; est
aaaatccgggcttgcggccgctggcgtagtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactacacgggccg

SEQ ID NO: 411 - DNA, 377 bp, Homo Sapiens
  Umbilical cord
  sig_peptide 198..254: Von Heijne matrix
  score 6.10
  misc_feature 53..376: seq IILLIHTMQVCTT/HP; blastn; identity 97; region 1..324
  id AA143123
  misc_feature complement(192..316): est; blastn; identity 100; region 312..436
  id AA142922
  misc_feature complement(310..376): est; blastn; identity 95; region 253..319
  id AA142922
  misc_feature complement(142..191): est; blastn; identity 90; region 436..485
  id AA142922
  misc_feature complement(130..327): est; blastn; identity 99; region 7..204
  id H54590
  misc_feature 241..376: est; blastn; identity 99; region 10..145
  id AA013161
  misc_feature 241..376: est; blastn; identity 99; region 10..145; id AA018245; est
aagtagcagaggcagcttctgagagcctgggcaggcagcagctggctgaccaagtccactggaagagaaggcttgtgccagccgggagaaggaagccggggacaggatgrragcaacaacacctttgcagacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagacctctttccaaaagccactccgacaacagccccaatgcctttaaggatgcgtcctccccagtgcctccccgag

SEQ ID NO: 412 - DNA, 488 bp, Homo Sapiens
  kidney
  sig_peptide 372..437: Von Heijne matrix
  score 6.10
  misc_feature 128..444: seq LFLTCLFWPLAAL/NV; blastn; identity 98; region 109..425
  id AA037143
  misc_feature 19..128: est; blastn; identity 100; region 1..110
  id AA037143
  misc_feature 443..483: est; blastn; identity 100; region 423..463
  id AA037143
  misc_feature 128..294: est; blastn; identity 100; region 121..287
  id W37233
  misc_feature 370..482: est; blastn; identity 96; region 367..479
  id W37233
  misc_feature 293..330: est; blastn; identity 97; region 287..324
  id W37233
  misc_feature 22..57: est; blastn; identity 97; region 15..50
  id W37233
  misc_feature 95..128: est; blastn; identity 100; region 89..122
  id W37233
  misc_feature 67..96: est; blastn; identity 100; region 60..89
  id W37233
  misc_feature 128..424: est; blastn; identity 98; region 100..396
  id N78012
  misc_feature 61..128: est; blastn; identity 98; region 34..101
  id N78012
  misc_feature 417..464: est; blastn; identity 95; region 390..437
  id N78012
  misc_feature 29..60: est; blastn; identity 100; region 1..32
  id N78012
  misc_feature 128..330: est; blastn; identity 99; region 107..309
  id W52332
  misc_feature 353..482: est; blastn; identity 97; region 335..464
  id W52332
  misc_feature 21..128: est; blastn; identity 100; region 1..108
  id W52332
  misc_feature 148..337: est; blastn; identity 95; region 116..305
  id AA081257
  misc_feature 60..128: est; blastn; identity 100; region 28..96
  id AA081257
  misc_feature 128..168: est; blastn; identity 97; region 95..135
  id AA081257
  misc_feature 432..467: est; blastn; identity 97; region 406..441
  id AA081257
  est
  misc_feature 377: n=a, g, c or t
  unsure -21: position -21 of amino acid sequence
  unsure -20: Xaa = His,Gln,Arg; position -20 of amino acid sequence; Xaa = Asp,Asn,Tyr
agacacttcctggtgggatccgagtgaggcgacggggtaggggttggcgctcaggcggcgaccatggcgtatcacggcctcactgtgcctctcattgtgatgagcgtgttctggggcttcgtcggctttcttggtgccttggttcatccctaagggtcctaaccggggagttatcattaccatgttggtgacctgttcagtttgctgctatctcttttggctgattgcaattctggcccaactcaaccctctctttggaccgcaattgaaaaatgaaaccatctggtatctgaagtatcattggccttgaggaagaagacatgctctacagtgctcagtctttgaggtcacgagaagagaatgccttctagatgcrndatcacctccaaaccagaccacttttcttgacttgcctgttttggccattagctgccttaaacgttaacagcacatttgaatgccttattctacaatgcagcgtggggatc

SEQ ID NO: 413 - DNA, 454 bp, Homo Sapiens
  Testis
  sig_peptide 179..334: Von Heijne matrix
  score 6.10
  misc_feature 167..265: seq LMAFLLSFYLIFT/NE; blastn; identity 97; region 139..237
  id T53688
  misc_feature 103..175: est; blastn; identity 91; region 74..146
  id T53688
  est
  misc_feature 391,438: n=a, g, c or t
  unsure -44: position -44 of amino acid sequence
  unsure 35: Xaa = Asn,Ser; position 35 of amino acid sequence; Xaa = Lys,Met,Arg,Thr
aatgcgcagaaacactgggcacagggggaggtaactgcagtaagtcccgcttggccctggagtccacgcggattttcgaagctggggctggcaagaggccgctggacaccacgctccagtcgtcagcccacttcctagctgaacagcgcgaggcggcggcagcgagccgggtcccaccatggccgcgaattattccagtaccartacccggagagaacatgtcaaagttaaaaccagctcccagccaggcttcctggaacggctgagcgagacctcgggtgggatgtttgtggggctcatggccttcctgctctccttctacctaattttcaccaatgagggccgcgcattgaagacggcaacctcattggctgaggggctctcgcttgtngtgtctcccgacagcatccacagtgtggctccggagaatgaaggaangctggtgcacatcatt

SEQ ID NO: 414 - DNA, 330 bp, Homo Sapiens
  Cancerous prostate
  sig_peptide 253..315: Von Heijne matrix
  score 6.10
  misc_feature 35..235: seq LEMLTAFASHIRA/RD; blastn; identity 99; region 15..215
  id W04921
  misc_feature 247..329: est; blastn; identity 97; region 227..309
  id W04921
  misc_feature complement(60..284): est; blastn; identity 97; region 216..440
  id N70602
  misc_feature complement(287..329): est; blastn; identity 95; region 172..214
  id N70602
  misc_feature 83..221: est; blastn; identity 99; region 1..139
  id W70167
  misc_feature 264..329: est; blastn; identity 96; region 183..248
  id W70167
  misc_feature 84..214: est; blastn; identity 100; region 1..131
  id W37690
  misc_feature 247..329: est; blastn; identity 96; region 165..247; id W37690; est
aacgagttcttccggggcggaggtcaccatggcagctgccttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggcatgacggctccgagccctgcgtggacgtgctgttcggaacgggcatcgcctgattatgcgcggcgctcatctcaccgctctggaaatgctcaccgccttcgcctcccacatccgggccagggacgcatcgggg

SEQ ID NO: 415 - DNA, 365 bp, Homo Sapiens
  Cancerous prostate
  sig_peptide 216..287: Von Heijne matrix
  score 6.10
  misc_feature 228..367: seq IILLIHTMQVCTT/HP; blastn; identity 99; region 143..282
  id AA143123
  misc_feature 89..206: est; blastn; identity 95; region 1..118
  id AA143123
  misc_feature complement(228..360): est; blastn; identity 98; region 7..139
  id H54590
  misc_feature complement(166..206): est; blastn; identity 97; region 164..204
  id H54590
  misc_feature complement(201..349): est; blastn; identity 95; region 312..460
  id AA142922
  misc_feature 274..367: est; blastn; identity 100; region 10..103
  id AA013161
  misc_feature 274..367: est; blastn; identity 100; region 10..103; id AA018245; est
aagtgtatctgggcagccccttccggcaaaacgcagcagtagcagaggcagcttctgagagcctgggcaggcagcagctggctgaccaagtccactggaagagaaggcttgtgccagccgggagaaggaagccggggacaggatgaaagcaacaacacctttgcagacagtcgaccggcccaaggactggtacaagacgatgttaagcaattcacatggtgcacaagccgatgatgacacagacatgtataatactccttatacatacaatgcaggtctgtacaacccaccctacagtgctcagtcacaccctgctgcaaagacccaaacctacagacctctttccaaaagccactccgacaaca

SEQ ID NO: 416 - DNA, 201 bp, Homo Sapiens
  Cancerous prostate
  sig_peptide 94..177: Von Heijne matrix
  score 6.00
  misc_feature 85..197: seq IGLMFLMLGCALP/IY; blastn; identity 100; region 85..197
  id N43024
  misc_feature 18..85: est; blastn; identity 92; region 17..84
  id N43024
  misc_feature 97..189: est; blastn; identity 98; region 80..172
  id T62095
  misc_feature 51..96: est; blastn; identity 93; region 35..80
  id T62095
  misc_feature 16..50: est; blastn; identity 100; region 1..35
  id T62095
  misc_feature 51..197: est; blastn; identity 98; region 26..172
  id W42796
  misc_feature 100..197: est; blastn; identity 92; region 114..211
  id AA030227
  misc_feature 100..197: est; blastn; identity 92; region 51..148; id AA118270; est
gttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcctacg

SEQ ID NO: 417 - DNA, 471 bp, Homo Sapiens
  Normal prostate
  sig_peptide 208..270: Von Heijne matrix
  score 6.00
  misc_feature 135..268: seq LLFPLTLVRSFWS/DM; blastn; identity 93; region 119..252
  id W20516
  misc_feature 25..92: est; blastn; identity 95; region 12..79
  id W20516
  misc_feature 352..391: est; blastn; identity 92; region 343..382
  id W20516
  misc_feature 401..433: est; blastn; identity 90; region 393..425
  id W20516
  misc_feature 93..122: est; blastn; identity 93; region 79..108
  id W20516
  misc_feature 203..471: est; blastn; identity 97; region 420..688
  id HSZ78368
  misc_feature 28..106: est; blastn; identity 91; region 46..124
  id HSZ78368
  misc_feature 135..204: est; blastn; identity 90; region 151..220
  id HSZ78368
  misc_feature 135..303: est; blastn; identity 95; region 132..300
  id R82255
  misc_feature 25..106: est; blastn; identity 91; region 24..105
  id R82255
  misc_feature 2..31: est; blastn; identity 90; region 2..31
  id R82255
  misc_feature 205..471: est; blastn; identity 99; region 55..321
  id H99530
  misc_feature 203..358: est; blastn; identity 93; region 391..546; id AA209097; est
aagaggggaacaagatggcggcgccgaaggggagcctctgggtgaggacccaactggggctcccgccgctgctgctgctgaccatggccttggccggaggttcggggaccgcttcggctgaagcatttgactcggkcytgggkkratacggcgtcttgccaccgggcctgtcagttgacctaccccttgcacacctaccctaagcttatgtccctgatgccaaaaatgcacctactctttcctctaactctggtgaggtcattctggagtgacatgatggactccgcacagagcttcataacctcttcatggactttttatcttcaagccgatgacggraaaatagttatattccagtctaagccagaaatccagtacgcaccacatttggagcaggagcctacaaatttgagagaatcatctctaagcaaaatgtcctatctgcaaatgagaaattcacaagcgcacagg

SEQ ID NO: 418 - DNA, 382 bp, Homo Sapiens
  Lung
  sig_peptide 38..298: Von Heijne matrix
  score 5.90
  misc_feature 100..384: seq SNILLASVGSVLG/AC; blastn; identity 96; region 123..407
  id W52706
  misc_feature 45..95: est; blastn; identity 92; region 69..119
  id W52706
  est
  misc_feature 349: n=a, g, c or t
  unsure 9: position 9 of amino acid sequence
  unsure 16: Xaa = Ala,Ser
  position 16 of amino acid sequence
  unsure 17: Xaa = Asp,Glu
  position 17 of amino acid sequence
  unsure 18: Xaa = Gly,Val; position 18 of amino acid sequence; Xaa =  * ,Glu,Lys
atttcctgggccaagttgggacccggacggcctcaccatgatgaaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgttgggggcctgcttggggaattcaccttchkcttctctcccagctgaacccgabgkndaagaagatgaggcaagagaaaatgtaccgccg

SEQ ID NO: 419 - DNA, 315 bp, Homo Sapiens
  Normal prostate
  sig_peptide 220..261: Von Heijne matrix
  score 5.80
  misc_feature 117..316: seq VTIILLLSCXFWA/VK; blastn; identity 94; region 102..301
  id H10706
  misc_feature 19..114: est; blastn; identity 95; region 6..101
  id H10706
  misc_feature 117..316: est; blastn; identity 94; region 74..273
  id AA043571
  misc_feature 42..114: est; blastn; identity 95; region 1..73
  id AA043571
  misc_feature 117..316: est; blastn; identity 94; region 99..298
  id W63643
  misc_feature 34..114: est; blastn; identity 95; region 18..98
  id W63643
  misc_feature 117..316: est; blastn; identity 94; region 38..237
  id AA081648
  misc_feature 117..265: est; blastn; identity 93; region 88..236
  id HUMHBC2885
  misc_feature 28..114: est; blastn; identity 94; region 1..87
  id HUMHBC2885
  unsure -4: est
  position -4 of amino acid sequence
  unsure 6: Xaa = Asp,Gly
  position 6 of amino acid sequence
  unsure 8: Xaa = Cys,Gly; position 8 of amino acid sequence; Xaa = Gly,Leu,Arg,Val
aaagtagggctggcgtasggccgccatgttgcagcaggatagtaatgatgacactgaagatgtttcactgtttgatgcggaagaggagacgactaatagaccaagrwaagccravdrrtcagrcgtccagtagcrtcgtttttccacttattctttcgagtcagtgcaatsatcgtctatcttctctgtgagttgstcagcagcagctttattacctgtatggtgacaattatcttgttgttgtcgtgtgrcttttgggcagtgaagaatgtcacakgtagaskaatggttggcctacgttggtggaatcacatt

SEQ ID NO: 420 - DNA, 403 bp, Homo Sapiens
  Lung
  sig_peptide 14..274: Von Heijne matrix
  score 5.80
  misc_feature 76..400: seq SNILLASVGSVSG/AC; blastn; identity 99; region 123..447
  id W52706
  misc_feature 21..71: est; blastn; identity 92; region 69..119
  id W52706
  unsure -86: est; position -86 of amino acid sequence; Xaa = Ile,Lys,Met
agacggcctcaccatgawraaacgggcagctgctgctgcagtgggaggagccctggcagtgggggctgtgcccgtggtgctcagtgccatgggcttcactggggcaggaatcgccgcgtcctccatagcagccaagatgatgtccgcagcagccattgccaacgggggtggtgtttctgcggggagcctggtggctactctgcagtccgtgggggcagctggactctccacatcatccaacatcctcctggcctctgttgggtcagtgtcgggggcctgcttggggaattcaccttcttcttctctcccagctgaacccgaggctaaagaagatgaggcaagagaaaatgtaccccaaggtgaacctccaaaacccccactcaagtcagagaaacatgagcgg

SEQ ID NO: 421 - DNA, 439 bp, Homo Sapiens
  Normal prostate
  sig_peptide 86..352: Von Heijne matrix
  score 5.70
  misc_feature 239..342: seq DLSLLSLPPGTSP/VG; blastn; identity 100; region 134..237
  id AA218802
  misc_feature 129..218: est; blastn; identity 97; region 22..111
  id AA218802
  est
  misc_feature 169: n=a, g, c or t
  unsure -83,14,17: position -83, 14, 17 of amino acid sequence
  unsure -62: Xaa = Leu,Val
  position -62 of amino acid sequence
  unsure -61: Xaa = Phe,Leu
  position -61 of amino acid sequence
  unsure 19: Xaa = Ala,Pro; position 19 of amino acid sequence; Xaa = Pro,Thr
aggcggcatttgcggccggcgccagggtggagagttgtgcgccggtccctgggcctgagctccggctccggctggggcgcctgcgatgtctcaagatggcggastgggcgaattaaagcacatggtgatgagtttccgggtgtctgagctccaggtgcttcttggcttnsctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgstgttggckstggcamcctgctgggccccaagcgtgaggtggacatgc

SEQ ID NO: 422 - DNA, 405 bp, Homo Sapiens
  Spleen
  sig_peptide 268..339: Von Heijne matrix
  score 5.70
  misc_feature 160..301: seq LLLPRVLLTMASG/SL; blastn; identity 92; region 127..268
  id W31492
  misc_feature 32..132: est; blastn; identity 94; region 1..101
  id W31492
  misc_feature 360..405: est; blastn; identity 93; region 331..376
  id W31492
  misc_feature 18..151: est; blastn; identity 97; region 1..134
  id H85714
  misc_feature 342..402: est; blastn; identity 91; region 237..297
  id H85714
  misc_feature 293..343: est; blastn; identity 98; region 187..237
  id H85714
  misc_feature 234..343: est; blastn; identity 95; region 119..228
  id H52756
  misc_feature 45..151: est; blastn; identity 97; region 20..126
  id H52756
  misc_feature 342..405: est; blastn; identity 92; region 228..291
  id H52756
  misc_feature 35..151: est; blastn; identity 100; region 2..118
  id R78970
  misc_feature 234..343: est; blastn; identity 95; region 111..220
  id R78970
  misc_feature 342..385: est; blastn; identity 90; region 220..263
  id R78970
  misc_feature 33..151: est; blastn; identity 95; region 1..119
  id R64509
  misc_feature 288..343: est; blastn; identity 94; region 167..222
  id R64509
  misc_feature 342..385: est; blastn; identity 90; region 222..265
  id R64509
  unsure -22: est
  position -22 of amino acid sequence
  unsure 4: Xaa = Ala,Glu
  position 4 of amino acid sequence
  unsure 6: Xaa = Leu,Pro
  position 6 of amino acid sequence
  unsure 13,19: Xaa = Ala,Pro,Thr; position 13, 19 of amino acid sequence; Xaa = Ala,Asp
aaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgcctctctgctcctgtcttttgtttggatgccggmgctgctgcctgtggcctcmcgccttttgttgctaccccgagtcttgctgaccatggcctctggaagcctccgacycagcvctcgmcggcctcggattccggmtctggctacgttccgggmtcggtctctg

SEQ ID NO: 423 - DNA, 407 bp, Homo Sapiens
  kidney
  sig_peptide 42..146: Von Heijne matrix
  score 5.70
  misc_feature 78..397: seq IFSFLDIVTLCRC/AQ; blastn; identity 95; region 54..373
  id T75227
  misc_feature 35..98: est; blastn; identity 98; region 10..73
  id T75227
  misc_feature 1..248: est; blastn; identity 98; region 4..251
  id HSC3GD011
  misc_feature 270..407: est; blastn; identity 97; region 29..166
  id HSC01E081
  misc_feature 243..274: est; blastn; identity 96; region 1..32
  id HSC01E081
  misc_feature 337..407: est; blastn; identity 97; region 1..71
  id T05865
  unsure 4: est
  position 4 of amino acid sequence
  unsure 58,84: Xaa = Phe,Leu,Ser
  position 58, 84 of amino acid sequence
  unsure 62: Xaa = Asp,Gly; position 62 of amino acid sequence; Xaa = Glu,Lys
gtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttymaaggcttggaacatcttagccctggatggaagcaactggcaaagaatagatctttttaactttcaaacagatgtagagggtcgagtggtggaaaatatctcgaagcgatgcggtggattcctgaggaagctcagcttgcgaggctgcattggtgttggggrttcctccttgragacctttgcacagaactgccgaaacattgaacatttgaacctcaatggatgcacaaaaatcactgrcagcacgtgt

SEQ ID NO: 424 - DNA, 228 bp, Homo Sapiens
  Brain
  sig_peptide 67..171: Von Heijne matrix
  score 5.70
  misc_feature 23..224: seq IFSFLDIVTLCRC/AQ; blastn; identity 100; region 1..202
  id HSC3GD011
  misc_feature 103..224: est; blastn; identity 93; region 54..175
  id T75227
  misc_feature 60..123: est; blastn; identity 98; region 10..73; id T75227; est
aaggacaacgggcgtcgcmrgcgccgtgtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcagggg

SEQ ID NO: 425 - DNA, 452 bp, Homo Sapiens
  Umbilical cord
  sig_peptide 18..353: Von Heijne matrix
  score 5.60
  misc_feature 25..312: seq SSCILPWLSKTNS/CP; blastn; identity 99; region 36..323
  id W44483
  misc_feature 305..398: est; blastn; identity 97; region 317..410
  id W44483
  misc_feature 398..447: est; blastn; identity 100; region 411..460
  id W44483
  misc_feature complement(181..321): est; blastn; identity 100; region 233..373
  id AA035386
  misc_feature complement(323..447): est; blastn; identity 100; region 108..232
  id AA035386
  misc_feature complement(109..184): est; blastn; identity 98; region 371..446
  id AA035386
  misc_feature complement(10..64): est; blastn; identity 92; region 494..548
  id AA035386
  misc_feature complement(77..112): est; blastn; identity 97; region 444..479
  id AA035386
  misc_feature 15..420: est; blastn; identity 99; region 12..417
  id H69070
  misc_feature 416..446: est; blastn; identity 96; region 414..444
  id H69070
  misc_feature 17..273: est; blastn; identity 98; region 1..257
  id AA057029
  misc_feature 305..447: est; blastn; identity 95; region 292..434
  id AA057029
  misc_feature 180..447: est; blastn; identity 98; region 167..434
  id W32750
  misc_feature 21..185: est; blastn; identity 97; region 7..171
  id W32750
  est
  misc_feature 450: n=a, g, c or t
  unsure 33: position 33 of amino acid sequence; Xaa = Gly,Arg,Trp
aagaaggctgggcagccatggcgtcctatttcgatgaacacgactgcgagccgtcggaccctgagcaggagacgcgaaccaacatgctgctggagctcgcaaggtcacttttcaataggatggactttgaagacttggggttggtagtagattgggaccaccacctgcctccaccagctgccaagactgtggttgagaacctccccaggacagtcatcagaggctctcaggctgagctcaagtgccccgtgtgtcttttggaatttgaggaggaggagactgccattgagatgccttgccatcaccttttccattccagctgcattctgccctggctaagcaagacaaattcctgtcccttgtgccgctatgagctgcccactgatgacgacacttatgaggagcacagacgagataaggctcgaaaacagcagcagcaacaccgaccangg

SEQ ID NO: 426 - DNA, 450 bp, Homo Sapiens
  Lymph ganglia
  sig_peptide 253..297: Von Heijne matrix
  score 5.60
  misc_feature 30..422: seq LILSLQVCRPATL/DQ; blastn; identity 98; region 12..404
  id W22200
  misc_feature 33..364: est; blastn; identity 98; region 1..332
  id R87595
  misc_feature 129..342: est; blastn; identity 100; region 96..309
  id AA031849
  misc_feature 39..123: est; blastn; identity 94; region 7..91
  id AA031849
  misc_feature 122..298: est; blastn; identity 97; region 110..286
  id R88526
  misc_feature 12..123: est; blastn; identity 100; region 1..112
  id R88526
  misc_feature 122..376: est; blastn; identity 95; region 49..303
  id T08643
  misc_feature 74..125: est; blastn; identity 100; region 2..53
  id T08643
  unsure 38: est; position 38 of amino acid sequence; Xaa = Ala,Pro
aaaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccaccttacccagcccagcccatgggcccaccggsctaccacgagaccctggctggaggagcagccgcgccccggg

SEQ ID NO: 427 - DNA, 272 bp, Homo Sapiens
  Surrenals
  sig_peptide 45..263: Von Heijne matrix
  score 5.60
  misc_feature 219..273: seq LRRLLGCLTLTLS/GR; blastn; identity 100; region 85..139
  id AA157672
  misc_feature 219..273: est; blastn; identity 100; region 86..140
  id AA157671
  misc_feature 57..94: est; blastn; identity 94; region 10..47; id HUML116; est
aattgcgtagttccgaataccctcggccacacctggccttctccatgctcggaataacttcctgcagcgaccaacaggctaaagagggggaaggtctggagggatccagcaccggctcctcctccggcaaccacggtgggagcggcggaggaaatggacataaacccgggtgtgaaaagccagggaatgaagcccgcgggagcgggaatctgggattcagaactctgagacgtctcctgggatgtttaactttgacactttctggaagaatt

SEQ ID NO: 428 - DNA, 344 bp, Homo Sapiens
  Brain
  sig_peptide 72..122: Von Heijne matrix
  score 5.60
  misc_feature 106..187: seq ALKLASWTSMALA/AS; blastn; identity 91; region 190..271
  id AA103102
  misc_feature 60..108: est; blastn; identity 93; region 143..191
  id AA103102
  est
  misc_feature 321: n=a, g, c or t
  unsure 34: position 34 of amino acid sequence
  unsure 67: Xaa = Asp,Tyr
  position 67 of amino acid sequence
  unsure 68: Xaa =  * ,Glu,Lys,Gln; position 68 of amino acid sequence; Xaa = Leu,Val
aaattccccgctaccgggttgcggccggaagccgggcgccgcggctctgcttccctcggggatctggcgacatggccagaaaggctctcaagcttgcttcgtggaccagcatggctcttgctgcctctggcatctacttctacagtaacaagtacttggaccctaatgactttggcgctgtcagggtgggcagagcagttgctacgacggctgtcatcagtkacgactacctcacttccctgaagagtgtcccttatggctcagaggagtacttgcagctgagatctaaggtgcaccttcgctctgccaggcgtctctgtnarstctgctgtgccaaccggggc

SEQ ID NO: 429 - DNA, 405 bp, Homo Sapiens
  Normal prostate
  sig_peptide 10..57: Von Heijne matrix
  score 5.60
  misc_feature 13..406: seq AALPAWLSLQSRA/RS; blastn; identity 97; region 1..394
  id AA284513
  misc_feature 18..343: est; blastn; identity 98; region 7..332
  id H99096
  misc_feature 363..403: est; blastn; identity 90; region 355..395
  id H99096
  misc_feature 13..371: est; blastn; identity 98; region 1..359
  id AA020823
  misc_feature 27..406: est; blastn; identity 97; region 17..396
  id N21197
  misc_feature 24..290: est; blastn; identity 97; region 11..277
  id AA083141
  est
  misc_feature 156,380: n=a, g, c or t
  unsure 33: position 33 of amino acid sequence
  unsure 60: Xaa = Arg,Ser
  position 60 of amino acid sequence
  unsure 108: Xaa = Phe,Leu; position 108 of amino acid sequence; Xaa = Ala,Glu,Gly,Val
ctcgcagccatggcggccgccgcgctcccagcatggctgtctctgcagtcgagggcaaggtctctgcgtgcattctccactgccgtctactcggccactccggtcccgacacctagcctgccggaaagaacacccggaaatgaaaggccaccaagnagaaaggcactacctcctaggacagagaaaatggctgttgaccaggactggcctagtgtttacccagttgcagcaccattbaaaccctctgcagtacctcttcctgttcgaatgggttatccagtaaaaaagggcgtgcccatggcaaaggagggaaatctagaacttttaaagattcccaattttctgcatttgactcctgtagcaattaaaaagcactgtgnrgcccttaaagatttttgcactgag

SEQ ID NO: 430 - DNA, 453 bp, Homo Sapiens
  Substantia nigra
  sig_peptide 118..312: Von Heijne matrix
  score 5.60
  misc_feature 92..455: seq CMLTLXXLSFILA/GL; blastn; identity 97; region 83..446
  id W37917
  misc_feature 15..95: est; blastn; identity 96; region 5..85
  id W37917
  misc_feature 104..455: est; blastn; identity 97; region 95..446
  id AA010474
  misc_feature 12..95: est; blastn; identity 98; region 1..84
  id AA010474
  misc_feature 104..314: est; blastn; identity 97; region 79..289
  id W77834
  misc_feature 368..455: est; blastn; identity 96; region 345..432
  id W77834
  misc_feature 32..106: est; blastn; identity 98; region 6..80
  id W77834
  misc_feature 312..373: est; blastn; identity 100; region 288..349
  id W77834
  misc_feature 103..392: est; blastn; identity 97; region 85..374
  id N78175
  misc_feature 23..94: est; blastn; identity 98; region 3..74
  id N78175
  misc_feature 389..455: est; blastn; identity 100; region 370..436
  id N78175
  misc_feature 183..455: est; blastn; identity 97; region 158..430
  id AA169869
  misc_feature 30..95: est; blastn; identity 98; region 1..66
  id AA169869
  misc_feature 140..190: est; blastn; identity 98; region 114..164
  id AA169869
  misc_feature 104..144: est; blastn; identity 97; region 77..117
  id AA169869
  est
  misc_feature 291..292,379: n=a, g, c or t
  unsure -8: position -8 of amino acid sequence
  unsure -7: Xaa = Phe,Leu
  position -7 of amino acid sequence
  unsure 23: Xaa = Ala,Cys,Asp,Gly,His,Asn,Pro,Arg,Ser,Thr,Tyr; position 23 of amino acid sequence; Xaa =  * ,Glu,Lys,Gln
gtagtgttagactgaagataaagtaagtgctgtttgggctaacaggatctcctcttgcagtctgcagcccaggacgctgattccagcagcgccttaccgcgcasccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttnnvcctttcattcatcttggcaggacttattgttggtggagcctgcatttacaagtacttcatgcccaagagcaccatttaccgtgganagatgtgcttttttgattctgaggatcctgcaaattcccttcgtggaggagagcctaacttcctgcctgtgact

SEQ ID NO: 431 - DNA, 187 bp, Homo Sapiens
  Thyroid
  sig_peptide 11..154: Von Heijne matrix
  score 5.60
  misc_feature 11..171: seq LLLSFVWMPALLP/DG; blastn; identity 93; region 1..161
  id HUM085F04B
  misc_feature 9..109: est; blastn; identity 98; region 1..101
  id AA143653
  misc_feature complement(62..155): est; blastn; identity 95; region 24..117
  id H17554
  misc_feature 103..185: est; blastn; identity 90; region 139..221
  id H18908
  misc_feature 109..185: est; blastn; identity 93; region 133..209
  id H85714
  unsure -24: est; position -24 of amino acid sequence; Xaa = Phe,Ile
aaaccgcgccatgatagggtcgggattggctggctctggaggcgcaggtggtccttcttctactgtcacatggtgcgcgctgwtttctaatcacgtggctgccacccaggcctctctgctcctgtcttttgtttggatgccggcgctgctgcctgatggcctcccgccwtttgttgctaccccgatg

SEQ ID NO: 432 - DNA, 468 bp, Homo Sapiens
  Lung (cells)
  sig_peptide 313..366: Von Heijne matrix
  score 5.60
  misc_feature 18..153: seq LXGFLFXVIVLTS/WI; blastn; identity 94; region 2..137
  id N40054
  misc_feature 217..334: est; blastn; identity 97; region 202..319
  id N40054
  misc_feature 332..422: est; blastn; identity 90; region 316..406
  id N40054
  misc_feature 149..205: est; blastn; identity 100; region 134..190
  id N40054
  misc_feature 217..334: est; blastn; identity 97; region 167..284
  id N27721
  misc_feature 52..153: est; blastn; identity 96; region 1..102
  id N27721
  misc_feature 332..415: est; blastn; identity 92; region 281..364
  id N27721
  misc_feature 149..205: est; blastn; identity 100; region 99..155
  id N27721
  misc_feature 6..137: est; blastn; identity 98; region 2..133
  id W25483
  misc_feature 217..296: est; blastn; identity 98; region 213..292
  id W25483
  misc_feature 148..205: est; blastn; identity 100; region 144..201
  id W25483
  misc_feature 25..148: est; blastn; identity 99; region 1..124
  id C17967
  misc_feature 217..315: est; blastn; identity 100; region 194..292
  id C17967
  misc_feature 148..205: est; blastn; identity 100; region 125..182
  id C17967
  misc_feature 332..379: est; blastn; identity 91; region 307..354
  id C17967
  misc_feature 41..205: est; blastn; identity 99; region 1..165
  id T47061
  misc_feature 217..334: est; blastn; identity 96; region 177..294
  id T47061
  misc_feature 329..369: est; blastn; identity 92; region 288..328
  id T47061
  unsure -7: est
  position -7 of amino acid sequence
  unsure -12: Xaa = Cys,Trp; position -12 of amino acid sequence; Xaa = Leu,Met
aataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcastatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctkhtgggcttcctcttctgsgtgatagtgctcacctcctggatcaccatcttccagatctaccggccccgctgggggtgcccttggggactacctctccttcacatacccctgggcacccctgacaacttctgcacatac

SEQ ID NO: 433 - DNA, 433 bp, Homo Sapiens
  Placenta
  sig_peptide 188..274: Von Heijne matrix
  score 5.60
  misc_feature 328..432: seq VVFMTVAASGASS/FA; blastn; identity 99; region 15..119
  id HUMGS01778
  misc_feature complement(256..309): est; blastn; identity 96; region 175..228; id HSAAAAJHX; est
acggttccgggcgttaccatcgtccgtgcgcaccgcccggcgtccaggtgagtctcccatctgcagagacgcggacgcgccggcccgcagttggcctgcggacgcggtggacggtttggcgcccaccaggcgatcaatactttggatttttaatttctagatttggcaattcttcgctgaagtcatcatgagctttttccaactcctgatgaaaaggaaggaactcattcccttggtggtgttcatgactgtggcggcgagtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtaacg

SEQ ID NO: 434 - DNA, 306 bp, Homo Sapiens
  Lung (cells)
  sig_peptide 103..147: Von Heijne matrix
  score 5.50
  misc_feature complement(28..242): seq LAHSLLLNEEALA/QI; blastn; identity 100; region 1..215; id N91097; est
gcgggaggtggggcatccgggtctcttggtggctgcttctacccccggagctcagctgatcttcccttccagactacgaggtgtgaatttcaaacttccgtaatggagttagcccacagtttattgctaaatgaagaagctttggctcaaatcaccgaagcaaaaagaccagttttcatctttgaatggttgcgatttcttgataaagtcttggttgctgccaacaagaccgatgtaaaggaaaaacagaaaaaacttgttgaacaattaactggattaataagtagttcacctggacccaccggg

SEQ ID NO: 435 - DNA, 325 bp, Homo Sapiens
  Prostate
  sig_peptide 56..139: Von Heijne matrix
  score 5.50
  misc_feature 6..322: seq LGYLVLSEGAVLA/SS; blastn; identity 99; region 15..331
  id H23844
  misc_feature 11..322: est; blastn; identity 98; region 21..332
  id H22656
  misc_feature 12..310: est; blastn; identity 99; region 8..306
  id AA036876
  misc_feature 22..204: est; blastn; identity 99; region 1..183
  id W05714
  misc_feature 205..305: est; blastn; identity 98; region 183..283
  id W05714
  misc_feature 40..322: est; blastn; identity 99; region 1..283; id R69117; est
ctgaagccggaagctacctatctggtagggagctcccccagcaccgaagactgcgatgacttctgcactgacccaggggctggagcgaatcccagaccagctcggctacctggtactgagtgaaggtgcagtgctggcgtcatctggggacctggagaatgatgagcaggcagccagtgccatctctgagctggtcagcacagcctgcggtttccggctgcaccgcggcatgaatgtgcccttcaagcgcctgtctgtggtctttggagaacacacactgctggtgacggtgtcaggacagagggtgtttgtggtgaagaggggg

SEQ ID NO: 436 - DNA, 455 bp, Homo Sapiens
  Brain
  sig_peptide 12..104: Von Heijne matrix
  score 5.50
  misc_feature 141..374: seq LVGVLWFVSVTTG/PW; blastn; identity 99; region 125..358
  id N47594
  misc_feature 65..135: est; blastn; identity 100; region 49..119
  id N47594
  misc_feature 388..452: est; blastn; identity 96; region 374..438
  id N47594
  misc_feature 131..333: est; blastn; identity 96; region 113..315
  id AA143062
  misc_feature 60..137: est; blastn; identity 97; region 43..120
  id AA143062
  misc_feature 323..374: est; blastn; identity 98; region 304..355
  id AA143062
  misc_feature 388..433: est; blastn; identity 95; region 371..416
  id AA143062
  misc_feature 60..333: est; blastn; identity 97; region 44..317
  id HUM172D06B
  misc_feature 388..434: est; blastn; identity 97; region 370..416
  id HUM172D06B
  misc_feature 23..61: est; blastn; identity 97; region 8..46
  id HUM172D06B
  misc_feature 60..374: est; blastn; identity 97; region 45..359
  id HUM159G08B
  misc_feature 15..61: est; blastn; identity 97; region 1..47
  id HUM159G08B
  misc_feature 131..355: est; blastn; identity 98; region 92..316
  id N34957
  misc_feature 68..135: est; blastn; identity 100; region 30..97
  id N34957
  est
  misc_feature 288,375..376,385..387: n=a, g, c or t
  unsure -22: position -22 of amino acid sequence
  unsure 62: Xaa = Ala,Ser
  position 62 of amino acid sequence
  unsure 91: Xaa = Ala,Pro,Ser,Thr
  position 91 of amino acid sequence
  unsure 92: Xaa = Ala,Cys,Asp,Phe,Gly,His,Ile,Leu,Asn,Pro,Arg,Ser,Thr,Val,Tyr
  position 92 of amino acid sequence
  unsure 94: Xaa =  * ,Glu
  position 94 of amino acid sequence
  unsure 95: Xaa =  * ,Cys,Phe,Leu,Ser,Trp,Tyr; position 95 of amino acid sequence; Xaa = Asp,Phe,His,Ile,Leu,Asn,Val,Tyr
aggtctccaagatggcggccgcctggccgtctggtccgkctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggatnccagtggcaatgaaacacattttactgggaacgaagttggttttttcaagcccatatcttgccgaaatgtaaatggctattcctacnntkagcagtnnnwtgtctctttttcttggatggttgggagcagatcgattttaccttggataccctgctttgggtttgtt

SEQ ID NO: 437 - DNA, 200 bp, Homo Sapiens
  Cancerous prostate
  sig_peptide 117..155: Von Heijne matrix
  score 5.50
  misc_feature 170..201: seq MVLLTMIARVADG/LP; blastn; identity 93; region 157..188; id AA102919; est
aagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagtctggccgg

SEQ ID NO: 438 - DNA, 434 bp, Homo Sapiens
  Lung (cells)
  sig_peptide 141..179: Von Heijne matrix
  score 5.50
  misc_feature 121..436: seq MVLLTMIARVADG/LP; blastn; identity 93; region 57..372
  id AA023107
  misc_feature 194..436: est; blastn; identity 96; region 157..399; id AA102919; est
aacctcagcgggaagcggagacgcaagcagctkgatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagtctggccgggaccttcaacagtatcagagtcaggctaagcaactctttcgaaagttgaatgaacagtcccctaccagatgtaccttggaagcaggagccatgacttttcactacattattgagcagggggtgtgttatttggttttatgtgaagctgccttccctaagaagttggcttttgcctacctagaagatttgcactcagaatttgatgaacag

SEQ ID NO: 439 - DNA, 425 bp, Homo Sapiens
  Muscle
  sig_peptide 117..323: Von Heijne matrix
  score 5.40
  misc_feature 102..349: seq MMVLSLGIXLASA/SF; blastn; identity 99; region 86..333
  id AA035208
  misc_feature 21..95: est; blastn; identity 94; region 7..81
  id AA035208
  misc_feature 363..392: est; blastn; identity 100; region 349..378
  id AA035208
  misc_feature 102..291: est; blastn; identity 100; region 99..288
  id R97144
  misc_feature 11..95: est; blastn; identity 97; region 10..94
  id R97144
  misc_feature 102..392: est; blastn; identity 99; region 63..353
  id H64963
  misc_feature 38..95: est; blastn; identity 96; region 1..58
  id H64963
  misc_feature 102..392: est; blastn; identity 99; region 32..322
  id W03796
  misc_feature 102..356: est; blastn; identity 97; region 86..340
  id N73170
  misc_feature 17..95: est; blastn; identity 96; region 3..81
  id N73170
  unsure -5: est; position -5 of amino acid sequence; Xaa = Ile,Ser
aagaagatgaaggtaagtagaaaccgttgatgggactgagaaaccagagttaaaacctctttggagcttctgaggactcagctggaaccaamcgggcacaggttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagaaatcaaagttattgggactatccagatcttgtgtggcatgatggtattgagcttggggatcaktttggcatctgcttccttctctccaaattttacccaagtgacttctacactgttgaactctgcttacccattcataggaccctttttttttatcatctctggctctctatcaatc

SEQ ID NO: 440 - DNA, 442 bp, Homo Sapiens
  Placenta
  sig_peptide 38..112: Von Heijne matrix
  score 5.30
  misc_feature 27..371: seq AVTSLLSPTPATA/LA; blastn; identity 97; region 3..347
  id W81335
  misc_feature 369..406: est; blastn; identity 92; region 346..383
  id W81335
  misc_feature 401..430: est; blastn; identity 93; region 379..408
  id W81335
  misc_feature 35..274: est; blastn; identity 100; region 1..240
  id W03593
  misc_feature 274..382: est; blastn; identity 97; region 239..347
  id W03593
  misc_feature 41..274: est; blastn; identity 99; region 1..234
  id AA156841
  misc_feature 274..430: est; blastn; identity 96; region 233..389
  id AA156841
  misc_feature 26..202: est; blastn; identity 94; region 1..177
  id W81261
  misc_feature 188..336: est; blastn; identity 97; region 162..310
  id W81261
  misc_feature 349..430: est; blastn; identity 96; region 325..406
  id W81261
  misc_feature 41..273: est; blastn; identity 99; region 1..233
  id AA151036
  misc_feature 273..430: est; blastn; identity 96; region 232..389
  id AA151036
  est
  misc_feature 294: n=a, g, c or t
  unsure 61: position 61 of amino acid sequence
  unsure 90: Xaa = Ala,Asp,Gly,His,Ile,Leu,Asn,Pro,Arg,Ser,Thr,Val
  position 90 of amino acid sequence
  unsure 96: Xaa = Asp,Gly; position 96 of amino acid sequence; Xaa = Phe,Ile,Leu,Pro,Ser,Thr
atttttttttcgagaccggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagvntaaatgtctgtatgccctggaagaggggatagtccgctacactaaggaggtctacgtgcctcatcccagaaacacggaggctgtggrtctgatcaccaggctghycaagggtgctgtgctctacaagacttttgtcacgtggttcctg

SEQ ID NO: 441 - DNA, 425 bp, Homo Sapiens
  Substantia nigra
  sig_peptide 21..95: Von Heijne matrix
  score 5.30
  misc_feature 10..354: seq AVTSLLSPTPATA/LA; blastn; identity 97; region 3..347
  id W81335
  misc_feature 381..426: est; blastn; identity 93; region 376..421
  id W81335
  misc_feature 352..389: est; blastn; identity 97; region 346..383
  id W81335
  misc_feature 24..257: est; blastn; identity 99; region 1..234
  id AA156841
  misc_feature 257..426: est; blastn; identity 98; region 233..402
  id AA156841
  misc_feature 24..256: est; blastn; identity 99; region 1..233
  id AA151036
  misc_feature 256..426: est; blastn; identity 97; region 232..402
  id AA151036
  misc_feature 29..426: est; blastn; identity 98; region 16..413
  id W69555
  misc_feature 9..185: est; blastn; identity 94; region 1..177
  id W81261
  misc_feature 171..319: est; blastn; identity 97; region 162..310
  id W81261
  misc_feature 332..426: est; blastn; identity 98; region 325..419
  id W81261
  unsure 72: est; position 72 of amino acid sequence; Xaa = Asp,His,Ile,Leu,Asn,Val
ggaagtgagtgatcgaaagcatggcgtcggtggtgttggcgctgaggacccggacagccgttacatccttgctaagccccactccggctacagctcttgctgtcagatacgcatccaagaagtcgggtggtagctccaaaaacctcggtggaaagtcatcaggcagacgccaaggcattaagaaaatggaaggtcactatgttcatgctgggaacatcattgcaacacagcgccatttccgctggcacccaggtgcccatgtgggtgttgggaagaataaatgtctgtatgccctggaagaggggatavwccgctacactaaggaggtctacgtgcctcatcccagaaacacagaggctgtggatctgatcaccaggctgcccaagggtgctgtgctctacaagacttttgtccacgtggttcct

SEQ ID NO: 442 - DNA, 398 bp, Homo Sapiens
  Brain
  sig_peptide 111..281: Von Heijne matrix
  score 5.30
  misc_feature 97..329: seq AIALATVLFLIGA/FL; blastn; identity 100; region 89..321
  id W68068
  misc_feature 342..399: est; blastn; identity 100; region 334..391
  id W68068
  misc_feature 47..95: est; blastn; identity 100; region 40..88
  id W68068
  misc_feature 7..50: est; blastn; identity 95; region 1..44
  id W68068
  misc_feature 94..329: est; blastn; identity 99; region 78..313
  id H72445
  misc_feature 47..94: est; blastn; identity 100; region 32..79
  id H72445
  misc_feature 15..50: est; blastn; identity 94; region 1..36
  id H72445
  misc_feature 364..393: est; blastn; identity 90; region 349..378
  id H72445
  misc_feature 47..298: est; blastn; identity 99; region 62..313
  id AA083574
  misc_feature 296..329: est; blastn; identity 100; region 312..345
  id AA083574
  misc_feature 106..329: est; blastn; identity 99; region 97..320
  id AA157676
  misc_feature 12..99: est; blastn; identity 92; region 3..90
  id AA157676
  misc_feature 342..399: est; blastn; identity 100; region 333..390
  id AA157676
  misc_feature 94..329: est; blastn; identity 99; region 86..321
  id R70112
  misc_feature 47..94: est; blastn; identity 97; region 40..87; id R70112; est
atgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctcctaagatcccttataaggccatcgcacttgccactgtgctgtttttgattggcgcctttctcattattataggctccctcctgctgtcaggctacatcagcaaagggggggcagaccgggccgttccagtgctgatcattggcattctggtgttcctacccggattttaccac

SEQ ID NO: 443 - DNA, 355 bp, Homo Sapiens
  Testis
  sig_peptide 242..286: Von Heijne matrix
  score 5.60
  misc_feature 19..351: seq LILSLQVCRPATL/DQ; blastn; identity 97; region 12..344
  id W22200
  misc_feature 22..351: est; blastn; identity 97; region 1..330
  id R87595
  misc_feature 111..287: est; blastn; identity 97; region 110..286
  id R88526
  misc_feature 1..112: est; blastn; identity 97; region 1..112
  id R88526
  misc_feature 118..331: est; blastn; identity 100; region 96..309
  id AA031849
  misc_feature 28..112: est; blastn; identity 91; region 7..91
  id AA031849
  misc_feature 111..351: est; blastn; identity 95; region 49..289
  id T08643
  misc_feature 63..114: est; blastn; identity 98; region 2..53
  id T08643
  est
  misc_feature 349..350: n=a, g, c or t
  unsure 22: position 22 of amino acid sequence; Xaa = Asp,His,Asn,Tyr
gaaaattgaaactgagtggcccacgatgggaagasgggaaagcccaggggtacaggaggcctctgggtgaaggcagaggctaacatgaggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacnnaccag

SEQ ID NO: 444 - DNA, 400 bp, Homo Sapiens
  Testis
  sig_peptide 272..316: Von Heijne matrix
  score 5.60
  misc_feature 49..395: seq LILSLQVCRPATL/DQ; blastn; identity 98; region 12..358
  id W22200
  misc_feature 52..383: est; blastn; identity 98; region 1..332
  id R87595
  misc_feature 141..317: est; blastn; identity 97; region 110..286
  id R88526
  misc_feature 31..142: est; blastn; identity 100; region 1..112
  id R88526
  misc_feature 148..361: est; blastn; identity 100; region 96..309
  id AA031849
  misc_feature 58..142: est; blastn; identity 94; region 7..91
  id AA031849
  misc_feature 141..395: est; blastn; identity 96; region 49..303
  id T08643
  misc_feature 93..144: est; blastn; identity 100; region 2..53; id T08643; est
agatttgctttctttttctccaaaaggggaggaaattgaaactgagtggcccacgatgggaagaggggaaagcccaggggtacaggaggcctctgggtgaaggcagaggctaacatggggttcggagcgaccttggccgttggcctgaccatctttgtgctgtctgtcgtcactatcatcatctgcttcacctgctcctgctgctgcctttacaagacgtgccgccgaccacgtccggttgtcaccaccaccacatccaccactgtggtgcatgccccttatcctcagcctccaagtgtgccgcccagctaccctggaccaagctaccagggctaccacaccatgccgcctcagccagggatgccagcagcaccctacccaatgcagtacccaccttggg

SEQ ID NO: 445 - DNA, 441 bp, Homo Sapiens
  Brain
  sig_peptide 199..402: Von Heijne matrix
  score 5.20
  misc_feature 175..443: seq GVLLLLSSIHFQC/RR; blastn; identity 95; region 152..420
  id AA146275
  misc_feature 175..443: est; blastn; identity 95; region 152..420; id AA146400; est
atttttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacagaaccaacgaaacgtatgctttccttccaagggttagctgagttggcacatcgagaatatcaggcaggagattttgaggcagcbgagagacactgcatgcagctctggagacaagagccagacaatactggtgtgcttttattactttcatctatacacttccagtgtcgaaggctggacagatctgctcactttagcactctggca

SEQ ID NO: 446 - DNA, 377 bp, Homo Sapiens
  Brain
  sig_peptide 48..329: Von Heijne matrix
  score 5.00
  misc_feature 62..237: seq VILQLQFLFDVLQ/KT; blastn; identity 98; region 43..218
  id AA134795
  misc_feature 268..379: est; blastn; identity 100; region 248..359
  id AA134795
  misc_feature 19..65: est; blastn; identity 100; region 1..47
  id AA134795
  misc_feature 62..247: est; blastn; identity 97; region 43..228
  id AA134712
  misc_feature 243..379: est; blastn; identity 97; region 225..361
  id AA134712
  misc_feature 19..65: est; blastn; identity 100; region 1..47
  id AA134712
  unsure -64: est; position -64 of amino acid sequence; Xaa = Phe,Ser
atttgataggcgccgggcagctgagctggtaggaggaccagacggggatgttcggctccgccccccagcgtcccgtggccatgacgaccgctcagagggactccctgttgtggaagctcgcggggttgctgcgggagtyyggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccaca

SEQ ID NO: 447 - DNA, 386 bp, Homo Sapiens
  Brain
  sig_peptide 120..377: Von Heijne matrix
  score 5.00
  misc_feature 80..331: seq LILVGTSKHVAFG/KI; blastn; identity 98; region 61..312
  id N23581
  misc_feature 19..95: est; blastn; identity 94; region 1..77
  id N23581
  misc_feature 328..387: est; blastn; identity 98; region 310..369
  id N23581
  misc_feature 158..331: est; blastn; identity 100; region 119..292
  id AA088606
  misc_feature 328..387: est; blastn; identity 98; region 290..349
  id AA088606
  misc_feature 100..156: est; blastn; identity 96; region 62..118
  id AA088606
  misc_feature 52..103: est; blastn; identity 96; region 13..64
  id AA088606
  misc_feature complement(47..331): est; blastn; identity 97; region 234..518
  id HSGT511
  misc_feature complement(328..387): est; blastn; identity 96; region 177..236
  id HSGT511
  misc_feature 90..331: est; blastn; identity 91; region 73..314
  id W89716
  misc_feature 330..387: est; blastn; identity 93; region 314..371
  id W89716
  misc_feature 99..331: est; blastn; identity 91; region 118..350
  id W42358
  misc_feature 330..387: est; blastn; identity 93; region 350..407; id W42358; est
agtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgaccttacaacttttgatcttggtgggcacgagcaagcacgtcgcgtttggaaaaattatc

SEQ ID NO: 448 - DNA, 321 bp, Homo Sapiens
  Cancerous prostate
  sig_peptide 196..300: Von Heijne matrix
  score 5.00
  misc_feature 74..179: seq WYSTVGLLPPVRA/MS; blastn; identity 99; region 78..183
  id W42807
  misc_feature 176..261: est; blastn; identity 97; region 181..266
  id W42807
  misc_feature 1..74: est; blastn; identity 97; region 4..77
  id W42807
  misc_feature 262..291: est; blastn; identity 100; region 268..297
  id W42807
  misc_feature 78..321: est; blastn; identity 98; region 54..297
  id W44615
  misc_feature 28..61: est; blastn; identity 100; region 1..34
  id W44615
  misc_feature 55..321: est; blastn; identity 99; region 1..267
  id W69940
  misc_feature 57..255: est; blastn; identity 100; region 1..199
  id W16769
  misc_feature 255..321: est; blastn; identity 100; region 198..264
  id W16769
  misc_feature 7..195: est; blastn; identity 98; region 1..189
  id N46069
  misc_feature 222..290: est; blastn; identity 100; region 185..253; id N46069; est
aaagacgctcacgggcgcgcggactatcgggcggctaggctctctgaggaggctgccacagtgaagcaaccgtgacaagtggtgcccgaccagggacctgaacgaggaaggtctgccagagcagagaaagtgaaactgatcagacgaactacgaacccctggacgggagagtctgccggcggagaatataaggagatggacaaaccgtgtgggtgccctccaggtgtgtgtgaccatggaacgggagaccggagggatccatggtattcaaccgtgggcctgttacctccagtacgagccatgagccagcggaatctgaat

SEQ ID NO: 449 - DNA, 426 bp, Homo Sapiens
  Testis
  sig_peptide 25..132: Von Heijne matrix
  score 5.00
  misc_feature 220..386: seq ARALAALVPGVTQ/VD; blastn; identity 97; region 161..327
  id H07981
  misc_feature 58..211: est; blastn; identity 96; region 2..155
  id H07981
  misc_feature 214..376: est; blastn; identity 94; region 193..355
  id R59645
  misc_feature 108..208: est; blastn; identity 99; region 88..188
  id R59645
  misc_feature 28..107: est; blastn; identity 96; region 9..88
  id R59645
  misc_feature 220..426: est; blastn; identity 98; region 163..369
  id H19239
  misc_feature 115..220: est; blastn; identity 95; region 59..164
  id H19239
  misc_feature 58..107: est; blastn; identity 92; region 2..51
  id H19239
  misc_feature 32..209: est; blastn; identity 98; region 1..178
  id AA096397
  misc_feature 337..371: est; blastn; identity 97; region 296..330
  id AA096397
  misc_feature 237..266: est; blastn; identity 96; region 203..232
  id AA096397
  misc_feature 212..345: est; blastn; identity 93; region 145..278
  id W05578
  misc_feature 125..187: est; blastn; identity 98; region 59..121
  id W05578
  misc_feature 68..124: est; blastn; identity 100; region 1..57
  id W05578
  est
  unsure 68: Xaa = Asp,Glu
  unsure 75: position 75 of amino acid sequence; Xaa = Lys,Arg
agtttccggttcgcctccggagccatggcggcggcactgaagtgtctactgacattaggaagatggtgccccggccttggagtggctccccaggcccgggcgctcgccgccttagtacccggagtgacccaggtagataacaagtccggtttcctgcagaagaggcctcatcgccagcaccctggcatcctaaagctgccgcacgtgcggctgccacaggcactggctaacggtgcccagttattgctacttgggagcgctgggcccactatggagaatcaggtgcaaacactgaccagttatctctggagcagacatttgcctgtagagccagasgagttgcaaagacgggctargcatcttgagaaaaaattcctggaaaacccagacttatctcagacagaggagaaacttcgtggagcaggg

SEQ ID NO: 450 - DNA, 381 bp, Homo Sapiens
  Normal prostate
  sig_peptide 31..336: Von Heijne matrix
  score 4.90
  misc_feature 184..374: seq TVMSALSVAPSKA/RE; blastn; identity 98; region 160..350
  id AA045902
  misc_feature 47..130: est; blastn; identity 100; region 24..107
  id AA045902
  misc_feature 124..173: est; blastn; identity 94; region 100..149
  id AA045902
  misc_feature 27..173: est; blastn; identity 100; region 13..159
  id H45858
  misc_feature 184..282: est; blastn; identity 98; region 170..268
  id H45858
  misc_feature 281..376: est; blastn; identity 96; region 268..363
  id H45858
  misc_feature 5..130: est; blastn; identity 99; region 22..147
  id W42908
  misc_feature 184..267: est; blastn; identity 90; region 200..283
  id W42908
  misc_feature 305..361: est; blastn; identity 100; region 325..381
  id W42908
  misc_feature 124..173: est; blastn; identity 92; region 140..189
  id W42908
  misc_feature 184..376: est; blastn; identity 98; region 129..321
  id N40684
  misc_feature 56..173: est; blastn; identity 100; region 1..118
  id N40684
  misc_feature 204..336: est; blastn; identity 99; region 267..399
  id AA005400
  misc_feature 58..173: est; blastn; identity 99; region 120..235
  id AA005400
  est
  misc_feature 187: n=a, g, c or t
  unsure -50: position -50 of amino acid sequence
  unsure -18: Xaa = Asp,His,Asn,Tyr; position -18 of amino acid sequence; Xaa = Asn,Ser,Thr
gagtgtccttgcgcgtggatccgagcgaccatggtggcccgggtgtggtcgctgatgaggttcctcatcaagggaagtgtggctgggggcgccgtctacctggtgtacgaccaggagctgctggggcccagcgacaagagccaggcagccctacagaaggctggggaggtggtcccccccgccatgnaccagttcagccagtacgtgtgtcagcagacaggcctgcagataccccagctcccagcccctccaaagatttactttcccatccgtgactcctggavtgcaggcatcatgacggtgatgtcagctctgtcggtggccccctccaaggcccgcgagtactccaaggagggctgggagtatgtgaaggcgcttggg

SEQ ID NO: 451 - DNA, 469 bp, Homo Sapiens
  kidney
  sig_peptide 398..445: Von Heijne matrix
  score 4.90
  misc_feature 11..214: seq ELQNLXSLQGSQA/CS; blastn; identity 95; region 1..204
  id AA248187
  misc_feature 196..282: est; blastn; identity 93; region 185..271
  id AA248187
  misc_feature 302..350: est; blastn; identity 97; region 289..337
  id AA248187
  misc_feature 8..338: est; blastn; identity 97; region 11..341
  id T93683
  misc_feature 19..313: est; blastn; identity 98; region 1..295
  id AA015679
  est
  misc_feature 423: n=a, g, c or t
  unsure -8: position -8 of amino acid sequence; Xaa =  * ,Leu,Ser,Trp
agtttgtagcggacaacatggcggccttcatgctgggctcgctgctgcggacgttcaagcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggatgtggctgatgaagaaattgctdhcctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctatngagcttgcagggaagccaagcttgcagttccagcaagcaaagattt

SEQ ID NO: 452 - DNA, 241 bp, Homo Sapiens
  Brain
  sig_peptide 80..151: Von Heijne matrix
  score 4.90
  misc_feature 122..240: seq FFFSIQPFLPCSS/RP; blastn; identity 98; region 102..220
  id T30988
  misc_feature 21..112: est; blastn; identity 100; region 1..92
  id T30988
  misc_feature 122..225: est; blastn; identity 98; region 110..213
  id T30974
  misc_feature 13..112: est; blastn; identity 98; region 1..100
  id T30974
  misc_feature 122..240: est; blastn; identity 97; region 84..202
  id HSC0CC031
  misc_feature 39..112: est; blastn; identity 100; region 1..74
  id HSC0CC031
  misc_feature 122..240: est; blastn; identity 96; region 84..202
  id HSC0CD031
  misc_feature 39..112: est; blastn; identity 97; region 1..74
  id HSC0CD031
  misc_feature 124..240: est; blastn; identity 98; region 1..117
  id R56565
  est
  misc_feature 226..227: n=a, g, c or t
  unsure 26: position 26 of amino acid sequence; Xaa = Ala,Pro,Ser,Thr
aacacactccctctctctctctttttagcagcaacatacaagccggccatattagagagatggaaataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctnnctacctcgccctgg

SEQ ID NO: 453 - DNA, 430 bp, Homo Sapiens
  Cancerous prostate
  sig_peptide 110..346: Von Heijne matrix
  score 4.90
  misc_feature 180..411: seq WVIVLTSWITIFQ/IY; blastn; identity 99; region 167..398
  id N27721
  misc_feature 52..116: est; blastn; identity 95; region 38..102
  id N27721
  misc_feature 112..168: est; blastn; identity 100; region 99..155
  id N27721
  misc_feature 180..377: est; blastn; identity 98; region 202..399
  id N40054
  misc_feature 52..116: est; blastn; identity 93; region 73..137
  id N40054
  misc_feature 112..168: est; blastn; identity 100; region 134..190
  id N40054
  misc_feature 180..259: est; blastn; identity 98; region 213..292
  id W25483
  misc_feature 111..168: est; blastn; identity 100; region 144..201
  id W25483
  misc_feature 52..100: est; blastn; identity 100; region 85..133
  id W25483
  misc_feature 180..278: est; blastn; identity 100; region 194..292
  id C17967
  misc_feature 52..111: est; blastn; identity 98; region 65..124
  id C17967
  misc_feature 111..168: est; blastn; identity 100; region 125..182
  id C17967
  misc_feature 280..341: est; blastn; identity 95; region 293..354
  id C17967
  misc_feature 180..411: est; blastn; identity 90; region 273..504
  id AA032534
  misc_feature 107..168: est; blastn; identity 90; region 200..261
  id AA032534
  unsure 12: est; position 12 of amino acid sequence; Xaa =  * ,Tyr
acataactgaaagtagctaaggcaccccagccggaggaagtgagctctcctgggtcaaggcttgggtcttgccccgcagacccttgggacgacccggccccagcgcastatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccthggggactasctctccttcaccatacccctgggcacccctgacaacttctgcacatac

SEQ ID NO: 454 - DNA, 418 bp, Homo Sapiens
  Normal prostate
  sig_peptide 122..331: Von Heijne matrix
  score 4.90
  misc_feature 167..382: seq LVFVLLFIFVKRQ/IM; blastn; identity 96; region 144..359
  id T27537
  misc_feature 27..162: est; blastn; identity 99; region 2..137
  id T27537
  misc_feature 162..380: est; blastn; identity 96; region 89..307
  id AA057488
  misc_feature 75..172: est; blastn; identity 93; region 1..98
  id AA057488
  misc_feature 175..381: est; blastn; identity 99; region 72..278
  id H10316
  misc_feature 105..174: est; blastn; identity 92; region 1..70
  id H10316
  misc_feature 162..385: est; blastn; identity 96; region 60..283
  id T33282
  misc_feature 104..162: est; blastn; identity 98; region 1..59
  id T33282
  misc_feature 174..396: est; blastn; identity 95; region 65..287
  id R14076
  misc_feature 112..173: est; blastn; identity 91; region 1..62
  id R14076
  est
  misc_feature 383: n=a, g, c or t
  unsure -55: position -55 of amino acid sequence
  unsure -40: Xaa = Ala,Pro
  position -40 of amino acid sequence
  unsure 18: Xaa = Ala,Val
  position 18 of amino acid sequence
  unsure 23: Xaa = Ala,Pro,Ser,Thr; position 23 of amino acid sequence; Xaa = Cys,Gly
aattgcctgcctgagtcacgtgtcagggggaagctggaaggcgtcgttctcctttcccagctctcctgcctgtccgccatgttttcaggccgggtctggcttggtcttcccccgtaagraaatggccggggagctccaggggacccaggcgccgtcgcttcgdggasctgggctgaccagccaggacagcggggtaaacccgaacaattctgygcgaggtagggaggccatggcgtccggcagtaactggctctccggggtgaatgtcgtgctggtgatggcctacgggagcctggtgtttgtactgctatttatttttgtgaagaggcaaatcatgcgctttgcaatgaaatctcgaaggggacctcatgtccctgtrggrncacaatgcccccaakgttgctacaactatctgtat

SEQ ID NO: 455 - DNA, 361 bp, Homo Sapiens
  Normal prostate
  sig_peptide 116..283: Von Heijne matrix
  score 4.90
  misc_feature 93..362: seq FACVPGASPTTLA/FP; blastn; identity 99; region 91..360
  id C17648
  misc_feature 4..107: est; blastn; identity 93; region 1..104
  id C17648
  misc_feature 93..262: est; blastn; identity 100; region 93..262
  id W07727
  misc_feature 260..362: est; blastn; identity 98; region 261..363
  id W07727
  misc_feature 2..56: est; blastn; identity 100; region 4..58
  id W07727
  misc_feature 58..88: est; blastn; identity 100; region 59..89
  id W07727
  misc_feature 94..251: est; blastn; identity 100; region 95..252
  id W00492
  misc_feature 2..58: est; blastn; identity 100; region 4..60
  id W00492
  misc_feature 253..311: est; blastn; identity 96; region 255..313
  id W00492
  misc_feature 308..342: est; blastn; identity 97; region 311..345
  id W00492
  misc_feature 60..362: est; blastn; identity 98; region 64..366
  id N29017
  misc_feature 2..64: est; blastn; identity 93; region 8..70
  id N29017
  misc_feature 94..359: est; blastn; identity 99; region 121..386; id N31560; est
aaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagmgggtcccttttgtg

SEQ ID NO: 456 - DNA, 457 bp, Homo Sapiens
  kidney
  sig_peptide 230..307: Von Heijne matrix
  score 4.90
  misc_feature complement(230..459): seq VLCTNQVLITARA/VP; blastn; identity 95; region 565..794
  id HSZ78357
  misc_feature complement(2..205): est; blastn; identity 99; region 818..1021
  id HSZ78357
  misc_feature 312..389: est; blastn; identity 93; region 310..387
  id AA052404
  misc_feature 92..205: est; blastn; identity 99; region 62..175
  id H75454
  misc_feature 30..94: est; blastn; identity 98; region 1..65
  id H75454
  unsure -23: est
  position -23 of amino acid sequence
  unsure -21: Xaa = Ile,Leu
  position -21 of amino acid sequence
  unsure 12: Xaa = Ala,Ser; position 12 of amino acid sequence; Xaa = Ala,Glu
aacttccaagttgtagtgttgttgttttcagcctgctgctgctgctgctattgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgrcttcaaaaaaagccagaattgawccataatggaagaawtaagtkctccacttgtagaatttgtaaaagttttgtgcaccaaccaggttctcattactgccagggctgtgcctacaaaaaaggcatctgtgcgatgtgtggmaaaaaggttttggataccaaaaactacaagcaaacatctgtctagatgtattgatggaatttctggctttctaaatgattttactttctgccttgaattttcaaggcatagatgt

SEQ ID NO: 457 - DNA, 372 bp, Homo Sapiens
  Hypertrophic prostate
  sig_peptide 106..156: Von Heijne matrix
  score 4.80
  misc_feature 125..367: seq LXXVVAFVAPGES/QQ; blastn; identity 99; region 119..361
  id AA242967
  misc_feature 6..125: est; blastn; identity 97; region 1..120
  id AA242967
  misc_feature 125..261: est; blastn; identity 96; region 124..260
  id C18969
  misc_feature 2..125: est; blastn; identity 95; region 2..125
  id C18969
  misc_feature 253..311: est; blastn; identity 96; region 251..309
  id C18969
  misc_feature 125..367: est; blastn; identity 99; region 101..343
  id N40141
  misc_feature 24..125: est; blastn; identity 97; region 1..102
  id N40141
  misc_feature 125..329: est; blastn; identity 99; region 122..326
  id R78319
  misc_feature 9..125: est; blastn; identity 97; region 7..123
  id R78319
  misc_feature complement(125..367): est; blastn; identity 99; region 112..354
  id N27018
  misc_feature complement(73..125): est; blastn; identity 94; region 353..405
  id N27018
  unsure -12: est
  position -12 of amino acid sequence
  unsure -11: Xaa = Pro,Thr
  position -11 of amino acid sequence
  unsure 59: Xaa = Ile,Asn; position 59 of amino acid sequence; Xaa = His,Pro,Arg
attctttcttcgccaggctctctgctgactcaagttcttcagttcacgatcttctagttgcagcgatgagtgcacgagtgagatcaagatccagaggaagaggagatggtcaggaggctmmcgawtgtggttgcattcgtggctcccggtgaatctcagcaagaggaaccaccaactgacaatcaggatattgaacctggacaagagagagaaggaacacctccgatcgaagaacgtaaagtagaaggtgattgccaggaaatggatctggaaaagactcggagtgagcgtggagatggctctgatgtaaaagagaagactccacctaatcvtaagcatgctaagactaaagaagcaggagatgggccattg

SEQ ID NO: 458 - DNA, 459 bp, Homo Sapiens
  Lung (cells)
  sig_peptide 13..123: Von Heijne matrix
  score 4.80
  misc_feature 299..454: seq PIVRLLSCPGTVA/KD; blastn; identity 98; region 278..433
  id AA100750
  misc_feature 160..308: est; blastn; identity 97; region 138..286
  id AA100750
  misc_feature 24..159: est; blastn; identity 100; region 1..136
  id AA100750
  misc_feature 9..355: est; blastn; identity 99; region 1..347
  id N68686
  misc_feature 355..402: est; blastn; identity 100; region 348..395
  id N68686
  misc_feature 400..429: est; blastn; identity 96; region 394..423
  id N68686
  misc_feature 1..241: est; blastn; identity 90; region 5..245
  id H24263
  misc_feature 239..337: est; blastn; identity 95; region 244..342
  id H24263
  unsure 55: est; position 55 of amino acid sequence; Xaa = Leu,Arg
tkttttttagcaatggcggttcccggcgtggggctcttgacccgtttgaacctgtgtgcccggagaagaactcgagtccagcggcctatcgtcaggcttttgagttgcccaggaactgtggccaaagaccttaggagagacgagcagccttcagggagcgtggagacaggctttgaagacaagattcccaaaaggagattctcggagatgcaaaatgaaagacgagaacaggcacagcggactgttttaatacattgcccagagaaaatcagtgaaaacaagtttckkaaatatttatcccaatttggacctattaataatcatttcttctatgaaagctttggtctctatgctgtcgtagaattttgccaaaaggaaagcataggttcactgcagaatgggactcatactccaagcacggccatggagactgcaattccattcagatcacgttcttca

SEQ ID NO: 459 - DNA, 329 bp, Homo Sapiens
  Lymph ganglia
  sig_peptide 21..200: Von Heijne matrix
  score 4.80
  misc_feature 109..319: seq LVILSLKSQTLDA/ET; blastn; identity 95; region 43..253
  id AA017309
  misc_feature 93..124: est; blastn; identity 96; region 28..59
  id AA017309
  misc_feature complement(126..250): est; blastn; identity 100; region 1..125
  id T52392
  unsure 36: est; position 36 of amino acid sequence; Xaa = Lys,Arg
agtaagtccccccgcctcgcatgatggctgcggtgccgccgggcctggagccgtggaaccgtgtgagaatccctaaggcggggaaccgcagcgcagtgacagtgcagaaccccggcgcggcccttgacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggttgagcaatgtttaaagcgtttgaraaacatgaatttggagggcggg

SEQ ID NO: 460 - DNA, 385 bp, Homo Sapiens
  Brain
  sig_peptide 11..109: Von Heijne matrix
  score 4.80
  misc_feature 39..385: seq SLVHLLCQNQVLG/NP; blastn; identity 97; region 1..347
  id AA023764
  misc_feature 146..385: est; blastn; identity 95; region 145..384
  id C03036
  misc_feature 11..80: est; blastn; identity 98; region 2..71
  id C03036
  misc_feature 39..231: est; blastn; identity 99; region 1..193
  id R08519
  misc_feature 232..302: est; blastn; identity 94; region 193..263
  id R08519
  est
  misc_feature 287,331: n=a, g, c or t
  unsure 60: position 60 of amino acid sequence
  unsure 66: Xaa = Ala,Phe,Ile,Leu,Pro,Ser,Thr,Val
  position 66 of amino acid sequence
  unsure 72: Xaa = Asp,His; position 72 of amino acid sequence; Xaa = Lys,Asn
aagtggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagtkcatgattacaaagaaggaaccccagaagagaagacctactacatagaattatgggatgttggaggctctgtgggcagtgccagcagcgtgaaaagcacaagagcagtattctacaactccgtaaatggtattatwnycgtacacgacttaacvsatgggaagtcctcccaaaamttgcgncgttggtcattggaagctctcaacagggatttggtgccaactggagtcttggtg

SEQ ID NO: 461 - DNA, 274 bp, Homo Sapiens
  Brain
  sig_peptide 50..142: Von Heijne matrix
  score 4.80
  misc_feature 30..237: seq WAFSCGTWLPSRA/EW; blastn; identity 96; region 12..219
  id R19497
  misc_feature 236..270: est; blastn; identity 100; region 219..253
  id R19497
  misc_feature 54..238: est; blastn; identity 96; region 1..185
  id H75597
  misc_feature 236..270: est; blastn; identity 97; region 184..218
  id H75597
  misc_feature 60..238: est; blastn; identity 97; region 1..179
  id H93398
  misc_feature 236..270: est; blastn; identity 97; region 178..212
  id H93398
  misc_feature 98..270: est; blastn; identity 98; region 1..173
  id HUM030E11B
  misc_feature 1..127: est; blastn; identity 98; region 118..244
  id AA280273
  unsure 5: est; position 5 of amino acid sequence; Xaa = Ala,Thr
gcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctkrcagtgcgatcgattcagcccgaggagaaggagcgcattggccagttcgtctttgcccgggacgctaaggcagccatggctggtcgtctgatgataaggaaattagttgcagagaatcga

SEQ ID NO: 462 - DNA, 212 bp, Homo Sapiens
  Surrenals
  sig_peptide 12..89: Von Heijne matrix
  score 4.70
  misc_feature 90..208: seq LIMQLGSVLLTRC/PF; blastn; identity 98; region 105..223
  id HSC13B041
  misc_feature 2..99: est; blastn; identity 100; region 18..115
  id HSC13B041
  misc_feature 90..208: est; blastn; identity 98; region 71..189
  id T08849
  misc_feature 19..99: est; blastn; identity 98; region 1..81
  id T08849
  misc_feature 19..101: est; blastn; identity 98; region 1..83
  id H88132
  misc_feature 90..158: est; blastn; identity 92; region 71..139
  id H88132
  misc_feature 158..208: est; blastn; identity 100; region 140..190
  id H88132
  misc_feature 111..208: est; blastn; identity 100; region 92..189
  id T33149
  misc_feature 19..110: est; blastn; identity 97; region 1..92
  id T33149
  misc_feature 18..99: est; blastn; identity 98; region 1..82
  id AA121114
  misc_feature 158..196: est; blastn; identity 100; region 141..179; id AA121114; est
actttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgcgcgg

SEQ ID NO: 463 - DNA, 301 bp, Homo Sapiens
  Brain
  sig_peptide 128..220: Von Heijne matrix
  score 4.70
  misc_feature 40..293: seq LAVDSWWLDPGHA/AV; blastn; identity 95; region 19..272; id W52056; est
aagaactgcgtctcgcgacccaggcgcgggttcccggaggacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacctctggcagtcgactcctggtggctagatcctggccacgcagcggtggcacaggcacccccggccgtggcctctagctccctctttgacctctcagtgctcaagctccaccacagccgcggg

SEQ ID NO: 464 - DNA, 380 bp, Homo Sapiens
  kidney
  sig_peptide 282..329: Von Heijne matrix
  score 4.70
  misc_feature 93..282: seq SLAAALTLHGHWG/LG; blastn; identity 100; region 88..277
  id W02951
  misc_feature 40..93: est; blastn; identity 98; region 36..89
  id W02951
  misc_feature 347..381: est; blastn; identity 100; region 345..379
  id W02951
  misc_feature 7..41: est; blastn; identity 97; region 2..36
  id W02951
  misc_feature 316..347: est; blastn; identity 100; region 313..344
  id W02951
  misc_feature 283..316: est; blastn; identity 94; region 279..312
  id W02951
  misc_feature 93..305: est; blastn; identity 100; region 81..293
  id N40687
  misc_feature 12..93: est; blastn; identity 98; region 1..82
  id N40687
  misc_feature 305..381: est; blastn; identity 100; region 292..368
  id N40687
  misc_feature 93..305: est; blastn; identity 100; region 80..292
  id N44828
  misc_feature 305..381: est; blastn; identity 100; region 291..367
  id N44828
  misc_feature 40..93: est; blastn; identity 98; region 28..81
  id N44828
  misc_feature 93..381: est; blastn; identity 99; region 79..367
  id R91018
  misc_feature 14..93: est; blastn; identity 98; region 1..80
  id R91018
  misc_feature 93..305: est; blastn; identity 100; region 80..292
  id W19557
  misc_feature 13..93: est; blastn; identity 96; region 1..81
  id W19557
  misc_feature 305..380: est; blastn; identity 100; region 291..366; id W19557; est
aaggaacgagatggcggttctctggaggctgagtgccgtttgcggtgccctaggaggccgagctctgttgcttcgaactccagtggtcagamcctgctcatatctcagcatttcttcaggaccgacctatcccagaatggtgtggagtgcagcacatacacttgtcaccgagccaccattctggctccaaggctgcatctctccactggactagcgagagggttgtcagtgttttgctcctgggtctgcttccggctgcttatttgaatccttgctctgcgatggactattccctggctgcagccctcactcttcatggtcactggggccttggacaagttgttactgactatgttcatggggatgccttgcagaaagct

SEQ ID NO: 465 - DNA, 444 bp, Homo Sapiens
  kidney
  sig_peptide 181..396: Von Heijne matrix
  score 4.70
  misc_feature 138..348: seq LSLXASYIFGISG/FE; blastn; identity 97; region 128..338
  id HUM080D04B
  misc_feature 10..143: est; blastn; identity 94; region 1..134
  id HUM080D04B
  misc_feature 348..408: est; blastn; identity 98; region 339..399
  id HUM080D04B
  misc_feature 407..445: est; blastn; identity 94; region 397..435
  id HUM080D04B
  misc_feature 138..274: est; blastn; identity 96; region 127..263
  id H29248
  misc_feature 11..143: est; blastn; identity 94; region 1..133
  id H29248
  misc_feature 273..348: est; blastn; identity 98; region 263..338
  id H29248
  misc_feature 348..387: est; blastn; identity 97; region 339..378
  id H29248
  misc_feature 382..411: est; blastn; identity 93; region 374..403
  id H29248
  misc_feature 138..348: est; blastn; identity 97; region 128..338
  id HUM179H02B
  misc_feature 10..143: est; blastn; identity 94; region 1..134
  id HUM179H02B
  misc_feature 348..397: est; blastn; identity 98; region 339..388
  id HUM179H02B
  misc_feature 407..437: est; blastn; identity 100; region 396..426
  id HUM179H02B
  misc_feature 138..299: est; blastn; identity 95; region 135..296
  id H73551
  misc_feature 3..143: est; blastn; identity 94; region 1..141
  id H73551
  misc_feature 292..348: est; blastn; identity 98; region 290..346
  id H73551
  misc_feature 402..441: est; blastn; identity 97; region 407..446
  id H73551
  misc_feature 138..326: est; blastn; identity 96; region 94..282
  id W68502
  misc_feature 44..143: est; blastn; identity 94; region 1..100
  id W68502
  misc_feature 348..408: est; blastn; identity 98; region 306..366
  id W68502
  est
  misc_feature 175: n=a, g, c or t
  unsure -30: position -30 of amino acid sequence
  unsure -10: Xaa = Leu,Met; position -10 of amino acid sequence; Xaa = Cys,Ser
agttttcaggaratttggaagctgccgcagtagttggagtctaaggactcgtgacaatcttcgggtgcccttcgagagaaaaggggaggatgccactggagtcatcctcttcaatgccactatccttcccatctbybytdrccctcrgtaccacacaatactaacccttcccctnctctgatgtcttacatcacctcccaggagatgaagtgtattcttcactggtttgccaattggtcaggtccccagcgtgaacgtttcctagaggacctggtagctaaggcagtgccagaaaaattacaaccahtgctggatagtctggagcagcttagtgtgtctggggcagacgaccaccttctatctttgwgtgccagctacatctttgggatcagtggtttcgaggctggggctgagcaggagcgcaatgaatttgtcagacagtcg

SEQ ID NO: 466 - DNA, 433 bp, Homo Sapiens
  Brain
  sig_peptide 200..427: Von Heijne matrix
  score 4.70
  misc_feature 46..406: seq LIVYLWVVSFIAS/SS; blastn; identity 99; region 6..366
  id W31798
  misc_feature 55..406: est; blastn; identity 99; region 2..353
  id AA056667
  misc_feature 68..406: est; blastn; identity 99; region 4..342
  id AA131958
  misc_feature 35..368: est; blastn; identity 99; region 1..334
  id H10262
  misc_feature 77..406: est; blastn; identity 99; region 1..330
  id W95790
  unsure -14: est; position -14 of amino acid sequence; Xaa = His,Asn
aagacgaggtcatgaatcatgtgacggtggcttgaggaggaacctgtctttaaagctgtccctgaagtgacagcggagagaaccaggcagcccagaaaccccaggcgtggagattgatcctgcgagagaagggggttcatcatggcggatgacctaaagcgattcttgtataaaaagttaccaagtgttgaagggctccatgccattgttgtgtcagatagagatggagtacctgttattaaagtggcaaatgacaatgctccagagcatgctttgcgacctggtttcttatccacttttgcccttgcaacagaccaaggaagcaaacttggactttccaaaaataaaagtatcatctgttactataacacctaccaggtggttcmatttaatcgtttacctttgggtggtgagtttcatagccagcagcagt

SEQ ID NO: 467 - DNA, 245 bp, Homo Sapiens
  Surrenals
  sig_peptide 45..110: Von Heijne matrix
  score 4.70
  misc_feature 18..158: seq SVMGVCLLIPGLA/TA; blastn; identity 92; region 39..179
  id C15963
  misc_feature 139..239: est; blastn; identity 100; region 161..261
  id C15963
  misc_feature 17..219: est; blastn; identity 98; region 22..224
  id W07092
  misc_feature complement(2..239): est; blastn; identity 99; region 140..377
  id W72958
  misc_feature 2..239: est; blastn; identity 99; region 18..255
  id W24219
  misc_feature 2..239: est; blastn; identity 99; region 16..253
  id AA040714
  unsure 6: est; position 6 of amino acid sequence; Xaa = Lys,Arg
aaaggacccagaagtagggttttggcctaggtaacggggcagagatgtggttcgagattctccccggactctccgtcatgggcgtgtgcttgttgattccaggactggctactgcgtacatccacargttcactaaccggggcaaggaaaaaagggttgctcattttgggtatcactggagtctgatggaaagagataggcgcatctctggagttgatcgttactatgtgtcaaagggtccaggg

SEQ ID NO: 468 - DNA, 354 bp, Homo Sapiens
  Prostate
  sig_peptide 205..342: Von Heijne matrix
  score 4.60
  misc_feature 204..351: seq LLVSLVLRXPAKS/TR; blastn; identity 93; region 162..309
  id AA017973
  misc_feature 204..351: est; blastn; identity 93; region 181..328
  id AA021972
  misc_feature 204..351: est; blastn; identity 93; region 181..328
  id AA013987
  misc_feature 204..351: est; blastn; identity 93; region 168..315
  id AA014054
  misc_feature 204..351: est; blastn; identity 93; region 184..331
  id W80073
  unsure -5: est; position -5 of amino acid sequence; Xaa = Arg,Thr
agtttagcgaccggacccgaaacggggaagttgtcttgtgtggagaggttagtaaagcagcgcgcgcgtcaccagagtcgtttctcttcggagtcttaggtgatcgagggtgtgcccagggggcggacttgtttgcgcctcccgttccctcccaatttccaaacgtgtcaccccggcgccgacggccctgtgcaggggaagcagatggagttcaagctggaggctcatcgcatcgtcagcatctctctgggcaagatctacaactcgcgggtccagcgcggcggcatcaagctgcataagaacctcctggtctcgctggtgctgcgcasgcccgccaagtctacccgagcgggg

SEQ ID NO: 469 - DNA, 420 bp, Homo Sapiens
  Brain
  sig_peptide 94..384: Von Heijne matrix
  score 4.60
  misc_feature 37..215: seq IASGLGLXLDCWT/SS; blastn; identity 97; region 1..179
  id AA146876
  misc_feature 214..368: est; blastn; identity 98; region 179..333
  id AA146876
  misc_feature 370..399: est; blastn; identity 100; region 334..363
  id AA146876
  misc_feature 49..319: est; blastn; identity 99; region 15..285
  id AA044109
  misc_feature 371..414: est; blastn; identity 100; region 338..381
  id AA044109
  misc_feature 339..368: est; blastn; identity 93; region 307..336
  id AA044109
  misc_feature 52..362: est; blastn; identity 99; region 27..337
  id H21138
  misc_feature 372..407: est; blastn; identity 100; region 347..382
  id H21138
  misc_feature 52..254: est; blastn; identity 99; region 14..216
  id AA150025
  misc_feature 307..368: est; blastn; identity 98; region 271..332
  id AA150025
  misc_feature 253..315: est; blastn; identity 92; region 216..278
  id AA150025
  misc_feature 370..414: est; blastn; identity 97; region 332..376
  id AA150025
  misc_feature 59..368: est; blastn; identity 98; region 1..310
  id N28828
  misc_feature 370..414: est; blastn; identity 100; region 311..355
  id N28828
  est
  misc_feature 369: n=a, g, c or t
  unsure -6: Xaa = Ala,Ser,Thr
  unsure -28: position -28 of amino acid sequence; Xaa = Pro,Arg
aatctagccccgccccaggcgagggcgccgcacccacaccgcgctgcgcagttttgttctgctccagctgttcgaaggtgatccagacgcaagatggctgtcctctctaaggaatatggttttgtgcttctaactggtgctgccagctttataatggtggcccacctagccatcaatgtttccaaggcccgcaagaagtacaaagtggagtatcctatcatgtacagcacggaccctgaaaatgggcacatcttcaactgcattcagcgagcccaccagaacacgttggaagtgtatcctcscttcttattttttctagctgttggaggtgtttaccacccgcgtatagcttctggcctgggcttgdcnctggattgttggacgagttctttatgcttatggctattacacgggccgggg

SEQ ID NO: 470 - DNA, 406 bp, Homo Sapiens
  Brain
  sig_peptide 272..397: Von Heijne matrix
  score 4.60
  misc_feature 28..227: seq RIPSLPGSPVCWA/WP; blastn; identity 99; region 1..200
  id AA074804
  misc_feature 265..310: est; blastn; identity 97; region 238..283
  id AA074804
  misc_feature 227..263: est; blastn; identity 100; region 201..237
  id AA074804
  misc_feature 352..385: est; blastn; identity 94; region 328..361
  id AA074804
  misc_feature complement(259..408): est; blastn; identity 99; region 123..272
  id N93600
  misc_feature complement(85..207): est; blastn; identity 96; region 325..447
  id N93600
  misc_feature complement(202..408): est; blastn; identity 99; region 117..323
  id AA074748
  misc_feature complement(116..153): est; blastn; identity 97; region 375..412
  id AA074748
  misc_feature complement(167..202): est; blastn; identity 97; region 324..359
  id AA074748
  misc_feature complement(258..408): est; blastn; identity 99; region 123..273
  id N93603
  misc_feature complement(208..251): est; blastn; identity 97; region 280..323
  id N93603
  misc_feature complement(163..202): est; blastn; identity 97; region 329..368
  id N93603
  misc_feature complement(90..125): est; blastn; identity 94; region 411..446; id N93603; est
aaaaggaaagaggtysggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgccggggattcggacggagagcgcgaggactcggcggctgagcgcgcccgacagcagctagaggcgctgctcaacaagactatgcgcattcgcatgacagatggacggacactggtcggctgctttctctgcactgaccgtgactgcaatgtcatcctgggctcggcgcaggagttcctcaagccgtcggattccttctctgccggggagccccgtgtgctgggcctggccatgg

SEQ ID NO: 471 - DNA, 208 bp, Homo Sapiens
  Liver
  sig_peptide 56..103: Von Heijne matrix
  score 4.50
  misc_feature 56..207: seq RLLLRRFLASVIS/RK; blastn; identity 96; region 20..171
  id N41898
  misc_feature 69..207: est; blastn; identity 97; region 38..176; id H69272; est
acttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacg

SEQ ID NO: 472 - DNA, 400 bp, Homo Sapiens
  Lymph ganglia
  sig_peptide 311..385: Von Heijne matrix
  score 4.50
  misc_feature 124..343: seq FLLLLEVSHLLLI/IN; blastn; identity 97; region 103..322
  id H72703
  misc_feature 24..135: est; blastn; identity 99; region 4..115
  id H72703
  misc_feature 357..398: est; blastn; identity 97; region 336..377
  id H72703
  misc_feature 7..343: est; blastn; identity 97; region 1..337
  id W68324
  misc_feature 357..391: est; blastn; identity 100; region 351..385
  id W68324
  misc_feature 7..134: est; blastn; identity 95; region 1..128
  id AA054941
  misc_feature 191..283: est; blastn; identity 100; region 185..277
  id AA054941
  misc_feature 124..191: est; blastn; identity 92; region 117..184
  id AA054941
  misc_feature 361..398: est; blastn; identity 92; region 360..397
  id AA054941
  misc_feature 124..343: est; blastn; identity 97; region 97..316
  id AA128297
  misc_feature 27..134: est; blastn; identity 100; region 1..108
  id AA128297
  misc_feature 357..398: est; blastn; identity 97; region 330..371
  id AA128297
  misc_feature complement(153..300): est; blastn; identity 95; region 108..255
  id H72704
  misc_feature complement(291..343): est; blastn; identity 100; region 64..116
  id H72704
  misc_feature complement(101..151): est; blastn; identity 98; region 259..309
  id H72704
  misc_feature complement(357..398): est; blastn; identity 95; region 9..50; id H72704; est
agacgtgttcttccggtggcggasggcggattagccttcgcggggcaaaatggagctcgaggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctcctcatctccttagtggcctcactcttcatgggctttggagtcctcttcctgctgctctgggttggcatctacgtgtgagcacccaagggtaacaaccagatggcttcactgaaacctgcttttgtaaattacttttttttactgttgctggaagtgtcccacctgctgctcataataaatgcagaaggg

SEQ ID NO: 473 - DNA, 395 bp, Homo Sapiens
  Substantia nigra
  sig_peptide 156..386: Von Heijne matrix
  score 4.50
  misc_feature 226..396: seq LFWVIVLTSWITI/FQ; blastn; identity 100; region 202..372
  id N40054
  misc_feature 27..162: est; blastn; identity 94; region 2..137
  id N40054
  misc_feature 158..214: est; blastn; identity 100; region 134..190
  id N40054
  misc_feature 15..146: est; blastn; identity 98; region 2..133
  id W25483
  misc_feature 226..305: est; blastn; identity 98; region 213..292
  id W25483
  misc_feature 157..214: est; blastn; identity 100; region 144..201
  id W25483
  misc_feature 34..157: est; blastn; identity 99; region 1..124
  id C17967
  misc_feature 226..324: est; blastn; identity 100; region 194..292
  id C17967
  misc_feature 157..214: est; blastn; identity 100; region 125..182
  id C17967
  misc_feature 326..387: est; blastn; identity 95; region 293..354
  id C17967
  misc_feature 226..396: est; blastn; identity 100; region 167..337
  id N27721
  misc_feature 61..162: est; blastn; identity 96; region 1..102
  id N27721
  misc_feature 158..214: est; blastn; identity 100; region 99..155
  id N27721
  misc_feature 50..214: est; blastn; identity 99; region 1..165
  id T47061
  misc_feature 226..377: est; blastn; identity 99; region 177..328; id T47061; est
aaaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcastatgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatc

SEQ ID NO: 474 - DNA, 189 bp, Homo Sapiens
  Lung (cells)
  sig_peptide 73..135: Von Heijne matrix
  score 4.40
  misc_feature 80..115: seq AVASSFFCASLFS/AV; blastn; identity 100; region 170..205; id AA090974; est
atttttttcttgctcgtgggctcggacgagtacggagcgcctgcagggacagcctggataaaggctcacttgatggctcagttgggagcagttgtggctgtggcttccagtttcttttgtgcatctctcttctcagctgtgcacaagatagaagagggacatattggggtatattacagaggcggtgtg

SEQ ID NO: 475 - DNA, 313 bp, Homo Sapiens
  kidney
  sig_peptide 122..196: Von Heijne matrix
  score 4.40
  misc_feature 62..308: seq LVFMVPLVGLIHL/GW; blastn; identity 95; region 16..262
  id AA044042
  misc_feature 46..78: est; blastn; identity 90; region 1..33
  id AA044042
  misc_feature 75..308: est; blastn; identity 97; region 6..239
  id AA127902
  misc_feature 93..308: est; blastn; identity 99; region 1..216
  id AA056679
  misc_feature complement(104..308): est; blastn; identity 99; region 246..450
  id W93399
  misc_feature 126..308: est; blastn; identity 97; region 2..184; id H39528; est
gcgaaggttgtcgggatccgcggcagcagcggctgcttgagatctgtttctggggcctctggcggtggcggcctggggcggcgcgacggctggtgcgcaggtacactgatgctgaagtactatgagccttcggaacttgtggagagactacaaagttttggtttttatggtccctttagttgggctcatacatttggggtggtacagaatcaaaagcagccctgttttccaaatacctaaaaacgacgacattcctgagcaagatagtctgggactttcaaatcttcagaagagccaaatccaggggatactg

SEQ ID NO: 476 - DNA, 415 bp, Homo Sapiens
  Spleen
  sig_peptide 341..409: Von Heijne matrix
  score 4.40
  misc_feature 57..306: seq VFCLLISIPTPSA/HL; blastn; identity 99; region 33..282; id AA088487; est
agtcgttgccatsgatcctggggacgactggctggtggaatccttgcgcttgtaaatcgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggaggattttcagacaggtctatctttgatctaaagcatgtgccacataccaggtatggtcaattttgtgatccagccatccacacaggatgggatgggatggctgcaaatgcctgggggtattctgcctcctcatctccattcccaccccctcagcacacctg

SEQ ID NO: 477 - DNA, 458 bp, Homo Sapiens
  kidney
  sig_peptide 12..365: Von Heijne matrix
  score 4.40
  misc_feature 156..451: seq ILAHRLGLIPIHA/DP; blastn; identity 99; region 122..417
  id AA085629
  misc_feature 44..144: est; blastn; identity 94; region 14..114
  id AA085629
  misc_feature 156..259: est; blastn; identity 99; region 134..237
  id AA132309
  misc_feature 47..144: est; blastn; identity 95; region 29..126
  id AA132309
  misc_feature 274..314: est; blastn; identity 100; region 254..294
  id AA132309
  misc_feature 47..144: est; blastn; identity 92; region 15..112
  id H35088
  misc_feature 156..345: est; blastn; identity 98; region 63..252
  id HUML11153
  unsure -76: est
  position -76 of amino acid sequence
  unsure -72: Xaa = Ala,Asp,Asn,Thr
  position -72 of amino acid sequence
  unsure -70: Xaa = Glu,Gly; position -70 of amino acid sequence; Xaa = Ile,Asn
agagattgaagatggcggcttctcaggcggtggaggaaatgcggaccgcgtggttctgggggagtttggggttcgcaatgtccatactactgactttcccggtaactattccggttatgatgatgcctgggaccaggrmcggyttcgaagraagaawtttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcgg

SEQ ID NO: 478 - DNA, 383 bp, Homo Sapiens
  Muscle
  sig_peptide 12..242: Von Heijne matrix
  score 4.40
  misc_feature 61..188: seq FEARIALLPLLQA/ET; blastn; identity 97; region 45..172
  id AA156837
  misc_feature 252..334: est; blastn; identity 90; region 234..316
  id AA156837
  misc_feature 189..256: est; blastn; identity 98; region 172..239
  id AA156837
  misc_feature 16..64: est; blastn; identity 97; region 1..49
  id AA156837
  misc_feature 15..220: est; blastn; identity 97; region 1..206
  id AA196478
  misc_feature 252..334: est; blastn; identity 90; region 236..318
  id AA196478
  misc_feature 222..256: est; blastn; identity 97; region 207..241
  id AA196478
  misc_feature 61..226: est; blastn; identity 95; region 44..209
  id AA181144
  misc_feature 252..334: est; blastn; identity 90; region 235..317
  id AA181144
  misc_feature 17..64: est; blastn; identity 97; region 1..48
  id AA181144
  misc_feature 225..256: est; blastn; identity 96; region 209..240
  id AA181144
  misc_feature 185..334: est; blastn; identity 94; region 169..318
  id AA228369
  misc_feature 61..184: est; blastn; identity 98; region 46..169
  id AA228369
  misc_feature 22..64: est; blastn; identity 95; region 8..50
  id AA228369
  misc_feature 15..219: est; blastn; identity 97; region 1..205
  id W04828
  misc_feature 252..334: est; blastn; identity 90; region 236..318
  id W04828
  misc_feature 341..380: est; blastn; identity 100; region 323..362
  id W04828
  misc_feature 221..256: est; blastn; identity 97; region 206..241
  id W04828
  unsure 5: est
  position 5 of amino acid sequence
  unsure 22: Xaa = Lys,Arg
  position 22 of amino acid sequence
  unsure 25: Xaa = Lys,Gln
  position 25 of amino acid sequence
  unsure 28: Xaa = Leu,Pro
  position 28 of amino acid sequence
  unsure 31: Xaa = Lys,Asn
  position 31 of amino acid sequence
  unsure 32: Xaa = Glu,Lys
  position 32 of amino acid sequence
  unsure 33: Xaa =  * ,Ala,Cys,Asp,Glu,Gly,Ser,Trp,Tyr; position 33 of amino acid sequence; Xaa = Ala,Asp,Val
atactgcgagtatggcggcgtcaaaggtgaaacaggacatgcctccgccggggggctatgggcccatcgactacaaacggaacttrccgcgtcgaggactgtcgggctacagcatgctggccatagggattggaaccctgatctacgggcactggagcataatgaagtggaaccgtgagcgcaggcgcctacaaatcgaggacttcgaggctcgcatcgcgctgttgccactgttacaggcagaaaccgaccggargaccttgcagatgcttcgggagaacctggaggaggaggccatcatcatgmaggacgtscycgactggaasgtggggraakvvghtgttccacacaacccgctgggtgccccccttgatcggggagct

SEQ ID NO: 479 - DNA, 310 bp, Homo Sapiens
  Lymph ganglia
  sig_peptide 164..289: Von Heijne matrix
  score 4.40
  misc_feature 58..271: seq VLFFTGWWIIIDA/AV; blastn; identity 95; region 54..267
  id AA027968
  misc_feature 105..289: est; blastn; identity 92; region 94..278
  id N90497
  misc_feature 10..108: est; blastn; identity 95; region 1..99
  id N90497
  misc_feature 63..307: est; blastn; identity 97; region 21..265
  id HSC0SD021
  misc_feature 41..299: est; blastn; identity 95; region 1..259
  id T31694
  misc_feature 116..274: est; blastn; identity 95; region 61..219
  id R38457
  misc_feature 55..107: est; blastn; identity 98; region 1..53
  id R38457
  misc_feature 273..307: est; blastn; identity 100; region 219..253; id R38457; est
aatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccacccgg

SEQ ID NO: 480 - DNA, 398 bp, Homo Sapiens
  Brain
  sig_peptide 225..356: Von Heijne matrix
  score 4.40
  misc_feature 101..386: seq LVFLTFLSIPSFV/GL; blastn; identity 98; region 73..358
  id AA133050
  misc_feature 71..100: est; blastn; identity 96; region 42..71
  id AA133050
  misc_feature 168..313: est; blastn; identity 99; region 145..290
  id AA159550
  misc_feature 71..169: est; blastn; identity 98; region 47..145
  id AA159550
  misc_feature 339..394: est; blastn; identity 91; region 319..374
  id AA159550
  misc_feature 33..68: est; blastn; identity 91; region 10..45; id AA159550; est
aaggtgctcgtcatgcgcaatgtggcgctgcggcgggcggcagggcctgtgtgtgctgaggcggctgagcggcggacatgcacaccacagagcgtggcgatggaacagtaaccgggcttgtgagagggctctgcagtataaactaggagacaagatccatggattcaccgtaaaccaggtgacatctgttcccgagctgttcctgactgcagtgaagctcacccatgatgacacaggagccaggtatttacacctggccagagaaaacacgaataatctgttcagcgtgcagttccgtaccactcccatggacagtactggtgttcctcacattcttgagcataccgtcctttgtgggtctcagaaatatccgtgcagagacctttcttcaaaatgtt

SEQ ID NO: 481 - DNA, 458 bp, Homo Sapiens
  Substantia nigra
  sig_peptide 39..80: Von Heijne matrix
  score 4.40
  misc_feature complement(53..194): seq FLTALLWRGRIPG/RQ; blastn; identity 95; region 444..585
  id AA161193
  misc_feature complement(227..324): est; blastn; identity 94; region 311..408
  id AA161193
  misc_feature complement(328..406): est; blastn; identity 100; region 230..308
  id AA161193
  misc_feature complement(408..446): est; blastn; identity 92; region 188..226
  id AA161193
  misc_feature complement(328..406): est; blastn; identity 97; region 75..153
  id R06283
  misc_feature complement(275..324): est; blastn; identity 98; region 156..205
  id R06283
  misc_feature complement(408..446): est; blastn; identity 92; region 33..71
  id R06283
  misc_feature 328..384: est; blastn; identity 98; region 286..342
  id AA152388
  misc_feature 131..183: est; blastn; identity 96; region 89..141
  id AA152388
  misc_feature 283..324: est; blastn; identity 97; region 242..283
  id AA152388
  misc_feature 42..85: est; blastn; identity 90; region 1..44
  id AA152388
  misc_feature 351..406: est; blastn; identity 96; region 312..367
  id AA159107
  misc_feature 408..445: est; blastn; identity 94; region 371..408
  id AA159107
  misc_feature 193..225: est; blastn; identity 93; region 166..198
  id AA159107
  misc_feature complement(171..324): est; blastn; identity 90; region 313..466
  id AA152366
  misc_feature complement(328..406): est; blastn; identity 100; region 232..310
  id AA152366
  misc_feature complement(408..446): est; blastn; identity 92; region 190..228
  id AA152366
  est
  misc_feature 30: n=a, g, c or t
  unsure 50: position 50 of amino acid sequence
  unsure 82: Xaa = Ala,Gly,Pro,Arg
  position 82 of amino acid sequence
  unsure 83: Xaa = Lys,Asn,Arg,Ser,Thr; position 83 of amino acid sequence; Xaa = Gly,Arg,Ser
agcggagacgcagagtcttgagcagcgcgncaggcaccatgttcctgactgcgctcctctggcgcggccgcattcccggccgtcagtggatcgggaagcaccggcggccgcggttcgtgtcgttgcgcgccaagcagaacatgatccgccgcctggagatcgaggcggagaaccattactggctgagcatgccctacatgacccgggagcaggagcgcggccacgccssgttgcgcaggagggaggccttcgaggcsataaaggcggccgccacttccaagttccccccgcatagattcattgcggaccagctcgaccatctcavkvgtcaccaagaaatggtcctaatcctgagtcgtcacccttggattttatggatcacggagctgaccatctttacctggtctggactgaaaaactgtagcttgtgtgaaaatgagctttggaccagtctttat

SEQ ID NO: 482 - DNA, 398 bp, Homo Sapiens
  kidney
  sig_peptide 120..389: Von Heijne matrix
  score 4.30
  misc_feature 20..400: seq TCLTACWTALCCC/CL; blastn; identity 99; region 1..381
  id W56872
  misc_feature 27..317: est; blastn; identity 99; region 1..291
  id W31727
  misc_feature 22..375: est; blastn; identity 99; region 1..354
  id W16469
  misc_feature 45..400: est; blastn; identity 99; region 1..356
  id N31028
  misc_feature 22..375: est; blastn; identity 98; region 1..354
  id W16470
  unsure -61: est; position -61 of amino acid sequence; Xaa = His,Leu,Pro
aacttgctctgagacaggtgcggcaagtctactgcgggctggtccgggctcctcaggttcagacccgaccgttatccagtcggttcgtggagaggagaggtgsactttacaggtccccgatgaaccaagagaaccctccaccatatccaggccctggtccaacggccccatacccaccttatccaccacaaccaatgggtccaggachtatggggggaccctacccacctcctcaagggtacccctaccaaggatacccacagtacggctggcagggtggacctcaggagcctcctaaaaccacagtgtatgtggtagaagaccaaagaagagatgagctaggaccatccacctgcctcacagcctgctggacggctctctgttgctgctgtctctgg

SEQ ID NO: 483 - DNA, 367 bp, Homo Sapiens
  kidney
  sig_peptide 11..172: Von Heijne matrix
  score 4.30
  misc_feature 55..331: seq LIVWLLVKSFSES/GI; blastn; identity 97; region 56..332
  id AA022276
  misc_feature 2..57: est; blastn; identity 100; region 4..59
  id AA022276
  misc_feature 329..368: est; blastn; identity 95; region 329..368
  id AA022276
  misc_feature 55..284: est; blastn; identity 97; region 44..273
  id W87295
  misc_feature 284..331: est; blastn; identity 97; region 274..321
  id W87295
  misc_feature 12..57: est; blastn; identity 100; region 2..47
  id W87295
  misc_feature 329..368: est; blastn; identity 95; region 318..357
  id W87295
  misc_feature 68..331: est; blastn; identity 98; region 1..264
  id W01758
  misc_feature 329..368: est; blastn; identity 95; region 261..300
  id W01758
  misc_feature 60..259: est; blastn; identity 95; region 50..249
  id W57829
  misc_feature 12..58: est; blastn; identity 100; region 3..49
  id W57829
  misc_feature 22..235: est; blastn; identity 97; region 1..214
  id HUM417E03B
  unsure 53,58: est; position 53, 58 of amino acid sequence; Xaa = Glu,Lys
aagttccgccatggcctccttggaagtcagtcgtagtcctcgcaggtctcggcgggagctggaagtgcgcagtccacgacagaacaaacattcggtgcttttacctacctacaacgagcgcgargaactgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcatggaatgraaacatgccacaggraactacatcattattatggatgc

SEQ ID NO: 484 - DNA, 407 bp, Homo Sapiens
  Hypertrophic prostate
  sig_peptide 303..344: Von Heijne matrix
  score 4.20
  misc_feature 70..408: seq CPTCLCAPSXXWG/EP; blastn; identity 98; region 61..399
  id AA114853
  misc_feature 19..68: est; blastn; identity 100; region 11..60
  id AA114853
  misc_feature 18..402: est; blastn; identity 98; region 7..391
  id W23545
  misc_feature 70..409: est; blastn; identity 98; region 42..381
  id AA069652
  misc_feature 28..68: est; blastn; identity 100; region 1..41
  id AA069652
  misc_feature 18..343: est; blastn; identity 98; region 8..333
  id AA084987
  misc_feature 63..409: est; blastn; identity 98; region 1..347
  id AA101916
  est
  misc_feature 335: n=a, g, c or t
  unsure -4: position -4 of amino acid sequence
  unsure -3: Xaa = Lys,Asn,Arg,Ser,Thr; position -3 of amino acid sequence; Xaa = Ala,Pro
atccggtgcacgcgagtsttctgaaacgtcagctgcgctcccctaggagtgctgagcccgcggaaccgcagccatgactgaggctgatgtgaatccaaaggyctatccccttgccgatgcccacctcaccaagaagctactggacctcgttcagcagtcatgtaactataagcagcttcggaaaggwgccaatgaggccaccaaaaccctcaacaggggcatctctgagttcatcgtgatggctgcagacgccgagccactggagatcattctgcacctgccgctgctgtgtgaagacaagaatgtgccctacgtgtttgtgcgctccaagcavnscctggggagagcctgtggggtctccaggcctgtcatcgcctgttctgtcaccatcaaagaaggctcgcagc

SEQ ID NO: 485 - DNA, 168 bp, Homo Sapiens
  Brain
  sig_peptide 10..66: Von Heijne matrix
  score 4.20
  misc_feature 43..168: seq AVAASAASGQAEG/KK; blastn; identity 98; region 34..159
  id N52621
  misc_feature 8..38: est; blastn; identity 100; region 1..31
  id N52621
  misc_feature 21..168: est; blastn; identity 98; region 5..152; id AA157163; est
acttctaagatggctgccgctaccggtgcggtggcagcctcggccgcctcgggtcaggcggaaggtaaaaagatcaccgatctgcgggtcatcgatctgaagtccgagctgaagcggcggaacttagacatcaccggagtcaagaccgtgctcatctcccgactaagg

SEQ ID NO: 486 - DNA, 433 bp, Homo Sapiens
  kidney
  sig_peptide 23..73: Von Heijne matrix
  score 4.20
  misc_feature 132..343: seq SLLXRVSVTAVAA/LS; blastn; identity 97; region 95..306
  id AA102280
  misc_feature 37..139: est; blastn; identity 97; region 1..103
  id AA102280
  misc_feature 340..433: est; blastn; identity 97; region 304..397
  id AA102280
  misc_feature 132..433: est; blastn; identity 98; region 87..388
  id R13711
  misc_feature 71..139: est; blastn; identity 97; region 27..95
  id R13711
  misc_feature 132..401: est; blastn; identity 98; region 87..356
  id R61022
  misc_feature 71..139: est; blastn; identity 97; region 27..95
  id R61022
  misc_feature 132..389: est; blastn; identity 97; region 82..339
  id N44705
  misc_feature 50..139: est; blastn; identity 95; region 1..90
  id N44705
  misc_feature 387..433: est; blastn; identity 95; region 338..384
  id N44705
  misc_feature 126..433: est; blastn; identity 98; region 75..382
  id H29689
  est
  misc_feature 98: n=a, g, c or t
  unsure -10: position -10 of amino acid sequence
  unsure 9: Xaa = Leu,Arg
  position 9 of amino acid sequence
  unsure 67: Xaa = Cys,Gly,Arg,Ser
  position 67 of amino acid sequence
  unsure 113: Xaa = Phe,Ile; position 113 of amino acid sequence; Xaa = Ala,Glu
attcctcctgcccgtagtagccatggcggccatgagtttgttgckgcgggtttcggttactgcggtggcagctctgtctggccggccccttggcacyngcctcggatttgggggcttcctcactcgtggctttccgaaggctgctgctcctgttcgacacagtggagaccatgggaaaagactatttgtcatcagaccttctagattctatgacaggcgttttttgaagttattgagattctacattgcattgactgggattccagtagcawttttcataactctggtgaatgtattcattggtcaagctgaactagcagaaattccagaaggctatgtcccagaacactgggaatattataagcatcccatatcaagatggattgcccgtaatttctatgatagtcctgmaaagatatatgaaagaacaatg

SEQ ID NO: 487 - DNA, 453 bp, Homo Sapiens
  Lymph ganglia
  sig_peptide 61..135: Von Heijne matrix
  score 4.20
  misc_feature 86..452: seq LDLLRGLPRVSLA/NL; blastn; identity 98; region 43..409
  id W00599
  misc_feature 54..96: est; blastn; identity 97; region 12..54
  id W00599
  misc_feature 108..405: est; blastn; identity 97; region 107..404
  id AA088577
  misc_feature 33..100: est; blastn; identity 94; region 29..96
  id AA088577
  misc_feature 6..41: est; blastn; identity 91; region 1..36
  id AA088577
  misc_feature 40..189: est; blastn; identity 96; region 7..156
  id R18030
  misc_feature 188..311: est; blastn; identity 98; region 156..279
  id R18030
  misc_feature 100..261: est; blastn; identity 99; region 46..207
  id H85485
  unsure 53: est; position 53 of amino acid sequence; Xaa = Ile,Val
gagaccacgtggcctccgagcagctcagggcgcccttgaaagttcttggatctgcgggttatggccggtcccttgcagggcggtggggcccgggccctggacctactccggggcctgccgcgtgtgagcctggccaacttaaagccgaatcccggctccaagaaaccggagagaagaccaagaggtcggagaagaggtagaaaatgtggcagaggccataaaggagaaaggcaaagaggaacccggccccgcttgggctttgagggaggccagactccattttacatccgartcccaaaatacgggtttaacgaaggacatagtttcagacgccagtataagcctttgagtctcaatagactgcagtatcttattgatttgggtcgtgttgatcctagtcaacctattgacttaacccagcttgtcaatgggagaggtgtgaccatcgcgccg

SEQ ID NO: 488 - DNA, 425 bp, Homo Sapiens
  kidney
  sig_peptide 18..140: Von Heijne matrix
  score 4.10
  misc_feature 33..135: seq GILILWIIRLLFS/KT; blastn; identity 100; region 1..103
  id T11164
  misc_feature 133..223: est; blastn; identity 98; region 102..192; id T11164; est
aaaggaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggaccctgt

SEQ ID NO: 489 - DNA, 407 bp, Homo Sapiens
  Substantia nigra
  sig_peptide 162..398: Von Heijne matrix
  score 4.10
  misc_feature 147..328: seq QGVLFICFTCARS/FP; blastn; identity 97; region 124..305
  id W16517
  misc_feature 33..149: est; blastn; identity 98; region 7..123
  id W16517
  misc_feature 326..385: est; blastn; identity 96; region 302..361
  id W16517
  misc_feature 15..149: est; blastn; identity 97; region 10..144
  id H23328
  misc_feature 147..276: est; blastn; identity 96; region 145..274
  id H23328
  misc_feature 276..309: est; blastn; identity 94; region 275..308
  id H23328
  misc_feature 147..309: est; blastn; identity 97; region 146..308
  id H06320
  misc_feature 73..149: est; blastn; identity 98; region 69..145
  id H06320
  misc_feature 5..40: est; blastn; identity 97; region 1..36
  id H06320
  misc_feature 146..182: est; blastn; identity 97; region 222..258
  id T62768
  unsure -69: est
  position -69 of amino acid sequence
  unsure -32: Xaa = Lys,Met,Arg
  position -32 of amino acid sequence
  unsure -31: Xaa = Phe,Leu; position -31 of amino acid sequence; Xaa = Glu,Gln
aaaaactgaggcctgggagcaggaacctgtaggcagcgcttgagggtagcgggatagcagctgcaacgcgcgtgggaggcgggggctctgggcggaacaaaaatcacaggatgtcagaggatgtttcccgggaagaactgggataaaggggtcccagcaccatggaggacccgaaccctgaagagaacatgadgcagcaggattcacccaaggagagaagtccccagagcccaggaggcaacatctgccacctgggggccccgaagtgcacccgctgcctcatcaccttcgcagattccaagttssaggagcgtcacatgaagcgggagcacccagcggacttcgtggcccagaagctgcagggggtcctcttcatctgcttcacctgcgcccgctccttcccctct

SEQ ID NO: 490 - DNA, 490 bp, Homo Sapiens
  Normal prostate
  sig_peptide 65..160: Von Heijne matrix
  score 4.10
  misc_feature complement(166..452): seq RLLSSLLLTMSNN/NP; blastn; identity 98; region 16..302
  id AA062591
  misc_feature 401..445: est; blastn; identity 100; region 1..45
  id AA158358
  misc_feature 444..490: est; blastn; identity 93; region 43..89
  id AA158358
  misc_feature 401..445: est; blastn; identity 100; region 1..45
  id AA158431
  misc_feature 444..490: est; blastn; identity 93; region 43..89
  id AA158431
  unsure 96: est; position 96 of amino acid sequence; Xaa = Ala,Cys,Gly,Ser
aaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatacaaaatggctgaatgttatacaatgctaaaacaagataaagatgccattgctatacttgatgggkstcccttcaagacaaagaactcccaraataaacatgatgctggc

SEQ ID NO: 491 - DNA, 340 bp, Homo Sapiens
  Brain
  sig_peptide 125..298: Von Heijne matrix
  score 4.10
  misc_feature 26..337: seq LVHHCPTWQWATG/EE; blastn; identity 99; region 1..312
  id HSC26F061
  misc_feature 97..337: est; blastn; identity 91; region 20..260
  id W30546
  misc_feature 97..283: est; blastn; identity 91; region 66..252; id H34739; est
agggtgctgccwkccgggtgctgwtgcgagtcggtggcagcgaggacattttctgactccctggcccctgacacggctgcactttccatcccgtcgcggggccggccgctactccggccccaggatgcagaatgtgattaatactgtgaagggaaaggcactggaagtggctgagtacctgaccccggtcctcaaggaatcaaagtttaaggaaacaggtgtaattaccccagaagagtttgtggcagctggagatcacctagtccaccactgtccaacatggcaatgggctacaggggaagaattgaaagtgaaggcatacctaccaacaggcaaatgg

SEQ ID NO: 492 - DNA, 481 bp, Homo Sapiens
  Colon
  sig_peptide 209..472: Von Heijne matrix
  score 4.10
  misc_feature 116..289: seq CIQRLPWLLLCRG/IT; blastn; identity 99; region 89..262
  id W68068
  misc_feature 360..428: est; blastn; identity 98; region 334..402
  id W68068
  misc_feature 286..347: est; blastn; identity 100; region 260..321
  id W68068
  misc_feature 66..114: est; blastn; identity 100; region 40..88
  id W68068
  misc_feature 26..69: est; blastn; identity 95; region 1..44
  id W68068
  misc_feature 428..465: est; blastn; identity 100; region 401..438
  id W68068
  misc_feature 66..289: est; blastn; identity 99; region 62..285
  id AA083574
  misc_feature 3..45: est; blastn; identity 100; region 1..43
  id AA083574
  misc_feature 401..444: est; blastn; identity 93; region 401..444
  id AA083574
  misc_feature 314..347: est; blastn; identity 100; region 312..345
  id AA083574
  misc_feature 286..316: est; blastn; identity 96; region 283..313
  id AA083574
  misc_feature 127..289: est; blastn; identity 99; region 102..264
  id AA001460
  misc_feature 360..465: est; blastn; identity 99; region 336..441
  id AA001460
  misc_feature 286..347: est; blastn; identity 100; region 262..323
  id AA001460
  misc_feature 52..103: est; blastn; identity 98; region 28..79
  id AA001460
  misc_feature 113..289: est; blastn; identity 98; region 78..254
  id H72445
  misc_feature 286..347: est; blastn; identity 100; region 252..313
  id H72445
  misc_feature 66..113: est; blastn; identity 100; region 32..79
  id H72445
  misc_feature 34..69: est; blastn; identity 94; region 1..36
  id H72445
  misc_feature 382..411: est; blastn; identity 90; region 349..378; id H72445; est
agatcccgcctggggccggctgagtggcacttaagcgggccatgccatgcaaccttgggcgctgccaaccgtgggcgagctctgggtgtgcgggcggcctggcgcggcgctccgctgtgtcagcgtgttatgatgccgtcccgtaccaacctggctactggaatccccagtagtaaagtgaaatattcaaggctctccagcacagacgatggctacattgaccttcagtttaagaaaacccctccaaagatcccttataaggccatcgcacttgccactgtgctgttttgattggcgcctttctcattattataggctccctcctgctgtcaggctacatcagcaaagggggggcagaccgggccgttccagtgctgatcattggcattctggtgttcctacccggattttaccacctgcgcatcgcttactatgcatccaaaggctaccgtggttactcctatgcagggggatcactagt

SEQ ID NO: 493 - DNA, 338 bp, Homo Sapiens
  Brain
  sig_peptide 123..269: Von Heijne matrix
  score 4.00
  misc_feature 67..218: seq PSLAAGLLFGSXA/GL; blastn; identity 97; region 51..202
  id N55991
  misc_feature 16..74: est; blastn; identity 100; region 1..59
  id N55991
  misc_feature 89..231: est; blastn; identity 99; region 1..143
  id R57473
  misc_feature 232..339: est; blastn; identity 97; region 143..250
  id R57473
  misc_feature 140..243: est; blastn; identity 94; region 195..298
  id H79944
  misc_feature 243..279: est; blastn; identity 91; region 299..335
  id H79944
  misc_feature 140..237: est; blastn; identity 92; region 97..194
  id H70394
  misc_feature 235..325: est; blastn; identity 93; region 193..283
  id H70394
  misc_feature 140..325: est; blastn; identity 93; region 80..265
  id W31972
  unsure -2: est; position -2 of amino acid sequence; Xaa = Glu,Ile,Lys,Leu,Gln,Val
aaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtvwagccggcctgggtgcttaccagctgtatcaggatccaagraacgtttggggtttcctagccgctacatctgtt

SEQ ID NO: 494 - DNA, 302 bp, Homo Sapiens
  Normal prostate
  sig_peptide 108..161: Von Heijne matrix
  score 4.00
  misc_feature 95..241: seq VAVGLTIAAAGFA/GR; blastn; identity 98; region 92..238
  id R27748
  misc_feature 2..90: est; blastn; identity 97; region 1..89
  id R27748
  misc_feature 162..298: est; blastn; identity 97; region 116..252
  id T79527
  misc_feature 2..47: est; blastn; identity 100; region 11..56
  id T79527
  misc_feature 53..90: est; blastn; identity 97; region 61..98
  id T79527
  misc_feature 95..195: est; blastn; identity 99; region 59..159
  id R08734
  misc_feature 194..241: est; blastn; identity 93; region 159..206
  id R08734
  misc_feature 48..90: est; blastn; identity 97; region 14..56
  id R08734
  misc_feature 102..298: est; blastn; identity 92; region 32..228
  id H35655
  misc_feature 102..298: est; blastn; identity 90; region 108..304
  id AA038389
  unsure 13: est
  position 13 of amino acid sequence
  unsure 35: Xaa = Leu,Pro,Arg
  position 35 of amino acid sequence
  unsure 39: Xaa = Gly,Arg,Trp
  position 39 of amino acid sequence
  unsure 41: Xaa = Lys,Arg; position 41 of amino acid sequence; Xaa = Ala,Thr
agggggttgcgtcgctctctggtaaaggcgtgcaggtgttggccgcggcctctgagctgggatgagccgtgctcccggtggaagcaaggggagccccagcsggagccatggccagtacagtggtagcagttggactgaccattgctgctgcaggatttgcaggccgttacgttttgcaagccatgaagcatatggagcbtcaagtaaaacaagtttttcaaagcctaccaaaatctgccttcagtggtggctattatagaggtbggtttgaacccaraatgrcaaaacgggaagcagcgggg

SEQ ID NO: 495 - DNA, 465 bp, Homo Sapiens
  Brain
  sig_peptide 136..384: Von Heijne matrix
  score 4.00
  misc_feature 130..311: seq AFSFSRLLSQCRP/DC; blastn; identity 97; region 96..277
  id T32007
  misc_feature 33..130: est; blastn; identity 98; region 1..98
  id T32007
  misc_feature 130..314: est; blastn; identity 98; region 76..260
  id R19207
  misc_feature 53..130: est; blastn; identity 100; region 1..78
  id R19207
  misc_feature 130..314: est; blastn; identity 98; region 76..260
  id R36562
  misc_feature 53..130: est; blastn; identity 100; region 1..78
  id R36562
  misc_feature 130..314: est; blastn; identity 98; region 76..260
  id R59039
  misc_feature 71..130: est; blastn; identity 98; region 19..78
  id R59039
  misc_feature 130..314: est; blastn; identity 98; region 70..254
  id T35666
  misc_feature 59..130: est; blastn; identity 100; region 1..72; id T35666; est
aaagttctccttccaccttcccccacccttctctgccaaccgctgtttcagcccctagctggattccagccattgctgcagctgctccacagcccttttcaggacccaaacaaccgcagccgctgttccccaggratggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagcggttcaggggccacatgcttttcggtataaagcattctccttctctaggttgctatcacagtgcagacctgactgcctgaatatgctcaggagatttagtcaatattgtctgtatttggttatggaaaaggctctcctttttttttttttt

SEQ ID NO: 496 - DNA, 401 bp, Homo Sapiens
  Brain
  sig_peptide 243..368: Von Heijne matrix
  score 4.00
  misc_feature 132..289: seq ITSSLFLGRGSVA/SN; blastn; identity 99; region 117..274
  id R14800
  misc_feature 15..130: est; blastn; identity 93; region 1..116
  id R14800
  misc_feature 315..368: est; blastn; identity 96; region 302..355
  id R14800
  misc_feature 284..316: est; blastn; identity 100; region 270..302
  id R14800
  misc_feature 132..330: est; blastn; identity 98; region 113..311
  id R59757
  misc_feature 54..130: est; blastn; identity 93; region 36..112
  id R59757
  misc_feature 18..58: est; blastn; identity 92; region 1..41
  id R59757
  misc_feature 132..330: est; blastn; identity 98; region 94..292
  id R25047
  misc_feature 54..130: est; blastn; identity 94; region 17..93
  id R25047
  misc_feature 59..352: est; blastn; identity 99; region 38..331
  id R23993
  misc_feature 163..294: est; blastn; identity 92; region 163..294
  id W23811
  misc_feature 132..194: est; blastn; identity 90; region 131..193
  id W23811
  misc_feature 305..354: est; blastn; identity 96; region 308..357
  id W23811
  misc_feature 350..390: est; blastn; identity 92; region 354..394; id W23811; est
aagaagccggtggccgcgcaggaggacggagccctaaccgcaacccgcgccgcgccgcgccgatttgatttgtatccactgtcaccagcactgctcacttaggactttctggatccagacccaggcagcgcacactggactcttgaggaagaaggagactctaattttggattccttggtggaggaaaataaaacactctggtcttgccgccaacgatgcaagtgtgactgctggcgtcttcatgagctccagaggtcacagcacgctaccaaggactctcatggcccctcggatgatttccgagggagacataggaggcattgctcaaatcacctcctctctattcctgggcagaggcagtgtggcctccaatcggcacctcctccaggctcgtggcatc

SEQ ID NO: 497 - DNA, 230 bp, Homo Sapiens
  Dystrophic muscle
  sig_peptide 66..119: Von Heijne matrix
  score 3.90
  misc_feature 47..228: seq PALCLFDVDGTLT/AP; blastn; identity 97; region 2..183
  id AA022583
  misc_feature complement(69..228): est; blastn; identity 97; region 281..440; id AA022584; est
aggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggaacgg

SEQ ID NO: 498 - DNA, 224 bp, Homo Sapiens
  Normal prostate
  sig_peptide 126..182: Von Heijne matrix
  score 3.90
  misc_feature 101..220: seq ILFHGVFYAGGFA/IV; blastn; identity 97; region 159..278
  id H97758
  misc_feature 50..103: est; blastn; identity 100; region 107..160
  id H97758
  misc_feature 101..185: est; blastn; identity 97; region 166..250
  id N59486
  misc_feature 50..103: est; blastn; identity 100; region 114..167
  id N59486
  misc_feature 50..103: est; blastn; identity 100; region 148..201
  id R09724
  misc_feature 5..54: est; blastn; identity 100; region 2..51
  id R09724
  misc_feature 101..130: est; blastn; identity 96; region 200..229
  id R09724
  misc_feature 101..178: est; blastn; identity 97; region 170..247
  id W90369
  misc_feature 53..103: est; blastn; identity 100; region 121..171
  id W90369
  misc_feature 173..218: est; blastn; identity 91; region 240..285
  id W90369
  misc_feature 14..103: est; blastn; identity 100; region 1..90; id N56221; est
actggaagaactcgtcatgctctttgtagcgtggtgcttctgttgctcacaggacaacttgcctttgatgattttcaagagagttgtgctatgatgtggcaaagtatgcaggaagcaggcggtcaatgcctctgggagcaaggatccttttccacggtgtgttctatgccgggggctttgccattgtgtattacctcattcaaaagtttcattccaggacactg

SEQ ID NO: 499 - DNA, 326 bp, Homo Sapiens
  Cancerous prostate
  sig_peptide 156..194: Von Heijne matrix
  score 3.90
  misc_feature 24..239: seq MLLSIGMLMLSAT/QV; blastn; identity 99; region 1..216
  id HUM429E03B
  misc_feature 235..327: est; blastn; identity 96; region 211..303
  id HUM429E03B
  misc_feature 124..327: est; blastn; identity 99; region 107..310
  id T80259
  misc_feature 31..130: est; blastn; identity 95; region 15..114
  id T80259
  misc_feature 39..283: est; blastn; identity 95; region 1..245
  id T31768
  misc_feature 271..327: est; blastn; identity 100; region 234..290
  id T31768
  misc_feature 102..327: est; blastn; identity 96; region 47..272
  id N32697
  misc_feature 55..97: est; blastn; identity 97; region 1..43
  id N32697
  misc_feature 65..327: est; blastn; identity 96; region 1..263
  id N44613
  unsure 21: est; position 21 of amino acid sequence; Xaa = Ala,Val
gcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtgattttacaacgagatgctgctctccatagggatgctcatgctgtcagccacacaagtctacaccatcttgactgtccagctctttgcattcttaaacctactgcctgtagaagyagacattttagcatataactttgaaaatgcatctcagacatttgatgacctccctgcaagatttggttat

SEQ ID NO: 500 - DNA, 398 bp, Homo Sapiens
  Uterus
  sig_peptide 111..185: Von Heijne matrix
  score 3.90
  misc_feature 28..395: seq WIAAVTIAAGTAA/IG; blastn; identity 96; region 1..368
  id AA150637
  misc_feature 33..297: est; blastn; identity 99; region 30..294
  id H02768
  misc_feature 181..372: est; blastn; identity 96; region 148..339
  id H70139
  misc_feature 33..179: est; blastn; identity 100; region 1..147
  id H70139
  misc_feature complement(267..394): est; blastn; identity 90; region 231..358
  id W46236
  misc_feature complement(184..277): est; blastn; identity 98; region 349..442
  id W46236
  misc_feature complement(109..164): est; blastn; identity 98; region 464..519
  id W46236
  misc_feature 188..366: est; blastn; identity 97; region 72..250
  id N30922
  misc_feature 117..180: est; blastn; identity 98; region 1..64
  id N30922
  est
  misc_feature 307: n=a, g, c or t
  unsure 40: position 40 of amino acid sequence
  unsure 41: Xaa = Phe,Leu
  position 41 of amino acid sequence
  unsure 64: Xaa = Ala,Glu,Gly,Ile,Lys,Arg,Thr,Val
  position 64 of amino acid sequence
  unsure 65: Xaa = Lys,Asn,Arg,Ser; position 65 of amino acid sequence; Xaa = Asp,His,Asn
aatcgcggagtcggtgctttagtacgccgctggcacctttactctcgccggccgcgcgaacccgtttgagctcggtatcctagtgcacacgccttgcaagcgacggcgccatgagtctgacttccagttccagcgtacgagttgaatggatcgcagcagttaccattgctgctgggacagctgcaattggttatctagcttacaaaagattttatgttaaagatcatcgaaataaagctatgataaaccttcacatccagaaagacaaccccaagatagtacatgcttttgacatggaggatttsrnagataaagctgtgtactgccgttgttggaggtccaaaaagttcccattctgtgatggggctcacacaarmvataacgaagagactgggctg

SEQ ID NO: 501 - DNA, 393 bp, Homo Sapiens
  Cancerous prostate
  sig_peptide 70..252: Von Heijne matrix
  score 3.90
  misc_feature 55..150: seq YTAVSVLAGPRWA/DP; blastn; identity 97; region 31..126
  id AA094226
  misc_feature 151..212: est; blastn; identity 100; region 126..187
  id AA094226
  misc_feature 24..58: est; blastn; identity 97; region 1..35
  id AA094226
  misc_feature 211..242: est; blastn; identity 96; region 185..216
  id AA094226
  misc_feature 55..263: est; blastn; identity 96; region 202..410
  id R54574
  misc_feature 24..58: est; blastn; identity 97; region 172..206
  id R54574
  misc_feature 55..176: est; blastn; identity 98; region 159..280
  id R13710
  misc_feature 174..235: est; blastn; identity 98; region 279..340
  id R13710
  misc_feature 24..58: est; blastn; identity 97; region 129..163
  id R13710
  misc_feature 55..165: est; blastn; identity 98; region 189..299
  id T78111
  misc_feature 163..203: est; blastn; identity 92; region 298..338
  id T78111
  misc_feature 24..58: est; blastn; identity 97; region 159..193
  id T78111
  misc_feature 201..235: est; blastn; identity 97; region 337..371
  id T78111
  est
  misc_feature 319,348: n=a, g, c or t
  unsure 6,32: position 6, 32 of amino acid sequence
  unsure 8: Xaa = Asp,Glu
  position 8 of amino acid sequence
  unsure 23: Xaa = Asp,His,Asn; position 23 of amino acid sequence; Xaa =  * ,Glu,Lys,Gln
aattacgcagagagaaagttacgagaaactcgttttcatcttcttggtttcatcytaaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgavagtvatttttctcccaagtttaacgaaaaggatgggcatgttgagaganagagcaagaatggcctgtatgagattganaatggaagaccgagaaatcctgcagacggactggactggtgggcc

SEQ ID NO: 502 - DNA, 474 bp, Homo Sapiens
  Cancerous prostate
  sig_peptide 349..438: Von Heijne matrix
  score 3.90
  misc_feature 154..352: seq LWMRWTVTSTTRA/WI; blastn; identity 98; region 137..335
  id HSC1QH021
  misc_feature 154..291: est; blastn; identity 98; region 126..263
  id HUML12288
  misc_feature 25..111: est; blastn; identity 98; region 1..87
  id HUML12288
  misc_feature 178..443: est; blastn; identity 98; region 1..266
  id R60742
  misc_feature 154..303: est; blastn; identity 97; region 133..282
  id HSC07D011
  misc_feature 53..147: est; blastn; identity 92; region 35..129
  id HSC07D011
  misc_feature 18..49: est; blastn; identity 96; region 1..32
  id HSC07D011
  misc_feature 154..298: est; blastn; identity 97; region 136..280
  id C04685
  misc_feature 25..147: est; blastn; identity 95; region 10..132
  id C04685
  est
  misc_feature 446..447,450: n=a, g, c or t
  unsure 3: position 3 of amino acid sequence; Xaa = Ala,Asp,Glu,Gly,Ile,Lys,Met,Asn,Arg,Ser,Thr,Val
aaaaccttagcaagatggcggctccctgggcgtccctgcgcctggtcgcccccatgtggaatgggcgtatcaggggcatccatcgcctgggtgcggcagtggccccagagggcaatcagaagaagaaaaggacaatamtccarktycctggmccvaastatttctacgatgtggaggctctgagggattacttgctccaaagggagatgtacaaggtgcatgagaaaaatcgatcttacacctggctggagaagcaacatggtccatacggcgcaggtgcctttttcatcctgaagcagggaggcgcagtcaagtttcgagacaaggagtggatcaggccagataagtatggccatttctctcaggagttctggaatttctgtgaagtgcctgtcgaagctgtggatgcggtggactgtgacatcaactacgagggcctggatmrnngcngaacctccgcagctggacatctcg

SEQ ID NO: 503 - DNA, 211 bp, Homo Sapiens
  Uterus
  sig_peptide 17..97: Von Heijne matrix
  score 3.80
  misc_feature 82..210: seq FVLGSARLGGSGS/MR; blastn; identity 96; region 49..177
  id AA082886
  misc_feature 47..83: est; blastn; identity 97; region 15..51
  id AA082886
  unsure 8: est; position 8 of amino acid sequence; Xaa =  * ,Leu,Pro,Gln,Ser
aacattaaccggcaggatgtcggaggtgcggctgccaccgctacgcgccctggacgactttgttctggggtcggcgcgtcttggcggctccggatccatgcgacccgctgcgatggtgyhaccgcgtcatcaacaacctcctctactaccaaaccaactaccttctctgcttcggcatcggcctcgctctcgccgggtacgtacggccacg

SEQ ID NO: 504 - DNA, 262 bp, Homo Sapiens
  Muscle
  sig_peptide 206..250: Von Heijne matrix
  score 3.80
  misc_feature 184..264: seq LVSATAWLEECWW/SE; blastn; identity 97; region 177..257
  id W93162
  misc_feature 113..183: est; blastn; identity 95; region 107..177
  id W93162
  misc_feature 184..264: est; blastn; identity 98; region 174..254
  id W67415
  misc_feature 62..112: est; blastn; identity 94; region 52..102
  id W67415
  misc_feature 141..183: est; blastn; identity 100; region 132..174
  id W67415
  misc_feature 184..264: est; blastn; identity 98; region 174..254
  id N44655
  misc_feature 113..183: est; blastn; identity 97; region 104..174
  id N44655
  misc_feature 54..183: est; blastn; identity 97; region 41..170
  id HSBA7H051
  misc_feature 184..240: est; blastn; identity 96; region 170..226
  id HSBA7H051
  misc_feature 14..52: est; blastn; identity 100; region 2..40
  id HSBA7H051
  misc_feature 77..183: est; blastn; identity 97; region 63..169
  id R37538
  misc_feature 184..264: est; blastn; identity 96; region 169..249
  id R37538
  misc_feature 15..53: est; blastn; identity 100; region 1..39
  id R37538
  est
  misc_feature 55,60: n=a, g, c or t
aggcggcgaagatggcggagaacagcggtcgcgccggcaagagcagcgggagcgncgcgnggaagggggcggtgtccgcagagcaggtgattgctggcttcaaccgccttcggcaggaacagcgaggcctggcatccaaagcagctgagttggagatggagttgaatgagcacagcctagtgaatcgatacactgaaggaggtagatgaaactcgtaagtgctaccgcatggttggaggartgctggtggagcgaactgtca

SEQ ID NO: 505 - DNA, 422 bp, Homo Sapiens
  Brain
  sig_peptide 309..410: Von Heijne matrix
  score 3.80
  misc_feature 142..382: seq LYVPLLAVCCLHS/VV; blastn; identity 99; region 120..360
  id HUML1108
  misc_feature 29..139: est; blastn; identity 97; region 17..127
  id HUML1108
  misc_feature 37..395: est; blastn; identity 98; region 37..395
  id AA156844
  misc_feature 32..395: est; blastn; identity 98; region 137..500
  id HSU51712
  misc_feature 237..395: est; blastn; identity 100; region 112..270
  id T70871
  misc_feature 133..235: est; blastn; identity 98; region 9..111
  id T70871
  misc_feature 77..185: est; blastn; identity 96; region 105..213
  id H48308
  misc_feature 177..286: est; blastn; identity 95; region 206..315
  id H48308
  misc_feature 284..317: est; blastn; identity 94; region 314..347; id H48308; est
aagcttccaaacccagggcttgcgcttgcctttgcctcttccaccgcgcagggaccatgtcggcggagaccgcgagcggccccacagaggaccaggtggaaatcctggagtacaacttcaacaaggtcgacaagcacccggattccaccacgctgtgcctcatcgcggccgaggcaggcctttccgaggaggagacccagaaatggtttaagcagcgcctggcaaagtggcggcgctcagaaggcctgccctcagagtgcagatccgtcacagactaaggagatggcaggcattgacagcttcactccatgaaggccatctctgtttctctcctccgcttaaccaagctgttgtggtttttcagcatagtgttgtatgttccattgctagctgtctgctgtttacacagtgttgtatttttt

SEQ ID NO: 506 - DNA, 513 bp, Homo Sapiens
  Thyroid
  sig_peptide 85..438: Von Heijne matrix
  score 3.80
  misc_feature 195..421: seq LMIALTVVGCIFM/VI; blastn; identity 96; region 179..405
  id AA010986
  misc_feature 20..109: est; blastn; identity 100; region 2..91
  id AA010986
  misc_feature 108..205: est; blastn; identity 93; region 91..188
  id AA010986
  misc_feature 443..505: est; blastn; identity 95; region 429..491
  id AA010986
  misc_feature 417..449: est; blastn; identity 90; region 402..434
  id AA010986
  misc_feature 19..205: est; blastn; identity 95; region 1..187
  id W96112
  misc_feature 316..494: est; blastn; identity 92; region 300..478
  id W96112
  misc_feature 195..336: est; blastn; identity 95; region 178..319
  id W96112
  misc_feature 69..513: est; blastn; identity 97; region 1..445
  id W44481
  misc_feature 14..205: est; blastn; identity 96; region 2..193
  id AA129812
  misc_feature 195..300: est; blastn; identity 98; region 184..289
  id AA129812
  misc_feature 349..405: est; blastn; identity 92; region 340..396
  id AA129812
  misc_feature 301..352: est; blastn; identity 92; region 291..342
  id AA129812
  misc_feature 405..448: est; blastn; identity 97; region 397..440
  id AA129812
  misc_feature 2..290: est; blastn; identity 97; region 1..289
  id W40172
  misc_feature 342..439: est; blastn; identity 95; region 343..440
  id W40172
  misc_feature 285..342: est; blastn; identity 93; region 285..342
  id W40172
  est
  misc_feature 156,326,328,363: n=a, g, c or t
  unsure -95: position -95 of amino acid sequence
  unsure -38: Xaa =  * ,Cys,Trp
  position -38 of amino acid sequence
  unsure -37: Xaa = Ile,Lys,Met,Asn,Arg,Ser,Thr
  position -37 of amino acid sequence
  unsure -26: Xaa =  * ,Glu,Lys,Gln
  position -26 of amino acid sequence
  unsure -25: Xaa = Asp,Glu
  position -25 of amino acid sequence
  unsure 18: Xaa = Leu,Val; position 18 of amino acid sequence; Xaa = His,Asn
actccaacgctgggtgacattgagctcaccagcgccaccgtccccggcgaagttctgcgctggtcggcggagtagcaagtggccatggggagcctcagcggtctgcgcctggcagcaggaagctgttttaggttatgtgaaagagatgtttcctgntctctaaggcttaccagaagctctgatttaaagagaataaatggattttgcacaaaaccacaggaaagtcccggagctccatcccgcacttacaacagagtgcctttacacaaacctacggattggcagaaaaagatcctcatatggtcaggtcgcttcaaaaaggaaanbnaaatcccagagactgtctcgttggagatgcttgansttgcaaagaacaagatgcgagtgaagatcagctatctaatgattgccctgacggtggtaggatgcatcttcatggttattgagggcaagaaggctgcccaaagacacgagactttaacaagcttgmacttagaaaagaaagctcgtctg

SEQ ID NO: 507 - DNA, 412 bp, Homo Sapiens
  Brain
  sig_peptide 59..358: Von Heijne matrix
  score 3.70
  misc_feature 198..407: seq LASSFLFTMGGLG/FI; blastn; identity 98; region 190..399
  id AA001815
  misc_feature 41..147: est; blastn; identity 97; region 35..141
  id AA001815
  misc_feature 146..205: est; blastn; identity 91; region 139..198
  id AA001815
  misc_feature 198..400: est; blastn; identity 98; region 139..341
  id N42162
  misc_feature 60..205: est; blastn; identity 95; region 2..147
  id N42162
  misc_feature 198..354: est; blastn; identity 98; region 144..300
  id N24414
  misc_feature 62..147: est; blastn; identity 97; region 10..95
  id N24414
  misc_feature 146..205: est; blastn; identity 93; region 93..152
  id N24414
  misc_feature 198..414: est; blastn; identity 98; region 122..338
  id W76137
  misc_feature 75..147: est; blastn; identity 98; region 1..73
  id W76137
  misc_feature 146..205: est; blastn; identity 93; region 71..130
  id W76137
  misc_feature 198..360: est; blastn; identity 96; region 121..283
  id H03817
  misc_feature 77..147: est; blastn; identity 98; region 2..72
  id H03817
  misc_feature 346..402: est; blastn; identity 94; region 270..326
  id H03817
  misc_feature 146..205: est; blastn; identity 91; region 70..129
  id H03817
  est
  misc_feature 8..9,381: n=a, g, c or t
  unsure 8: position 8 of amino acid sequence; Xaa = Ala,Asp,Gly,Ile,Asn,Ser,Thr,Val
actgtttnngggaggcgcgtggggcttgaggccgagaacggcccttgctgccaccaacatggagactttgtaccgtgtcccgttcttagtgctcgaatgtcccaacctgaagctgaagaagccgccctggttgcacatgccgtcggccatgactgtgtatgctctggtggtggtgtcttacttcctcatcaccggaggaataatttatgatgttattgttgaacctccaagtgtcggttctatgactgatgaacatgggcatcagaggccagtagctttcttggcctacagagtaaatggacaatatattatggaaggacttgcatccagcttcctatttacaatgggaggtttaggtttcataatcctggacggatcgrntgcaccaaatatcccaaaactcaatagattc

SEQ ID NO: 508 - DNA, 243 bp, Homo Sapiens
  Cancerous prostate
  sig_peptide 73..111: Von Heijne matrix
  score 3.70
  misc_feature 136..238: seq MLVLRSGLTKALA/SR; blastn; identity 90; region 80..182
  id C05215
  unsure 6: est
  position 6 of amino acid sequence
  unsure 8: Xaa = His,Pro,Arg
  position 8 of amino acid sequence
  unsure 9: Xaa = Ile,Arg; position 9 of amino acid sequence; Xaa = Ile,Asn
cactcgggaagacttcagagaagtctcacaaaggactcggctggctgcttttctcagtgccgaagccgcgccatgctcgttctcagaagcggcctgaccaaggcgcttgcctcacggacgctcgcgcvtcagakaawttttgctcatcgagctgaagttcggaaagccttagccaactgtaaggaatggcaagaacaatctatcattccaaatttggctcgcattgataaacaagagaccagg

SEQ ID NO: 509 - DNA, 245 bp, Homo Sapiens
  Thyroid
  sig_peptide 30..137: Von Heijne matrix
  score 3.70
  misc_feature 112..241: seq NIESLAWTGGTLG/HP; blastn; identity 98; region 77..206
  id R87832
  misc_feature 37..113: est; blastn; identity 92; region 1..77
  id R87832
  misc_feature 112..241: est; blastn; identity 98; region 65..194
  id HUM427G10B
  misc_feature 49..113: est; blastn; identity 98; region 1..65
  id HUM427G10B
  misc_feature 112..241: est; blastn; identity 98; region 52..181
  id R52722
  misc_feature 62..113: est; blastn; identity 92; region 1..52
  id R52722
  misc_feature 111..241: est; blastn; identity 90; region 79..209
  id W41484
  unsure -21: est
  position -21 of amino acid sequence
  unsure 18: Xaa = Asp,Glu; position 18 of amino acid sequence; Xaa = Arg,Thr
gagtttcctgcgagctcggcttcctcaacatggctgcgcccttgtcagtggaggtggagttcggaggtggtgcggastcctgtttgacggtattaagaaacatcgagtcacttgcctggacaggaggaaccctgggacatccggaacctgctcatctggatcaagaagaatttgctaaaagagcggccasagttgttcatccagggagacagcgtgcggccaggaattctggtgctgactacagg

SEQ ID NO: 510 - DNA, 401 bp, Homo Sapiens
  Umbilical cord
  sig_peptide 198..392: Von Heijne matrix
  score 3.70
  misc_feature 22..403: seq FVGGLPVIFWSWA/GL; blastn; identity 98; region 1..382
  id AA127626
  misc_feature 64..349: est; blastn; identity 98; region 44..329
  id W39584
  misc_feature 349..403: est; blastn; identity 96; region 330..384
  id W39584
  misc_feature 24..60: est; blastn; identity 100; region 3..39
  id W39584
  misc_feature complement(47..403): est; blastn; identity 98; region 68..424
  id N32838
  misc_feature complement(56..403): est; blastn; identity 98; region 67..414
  id AA121528
  misc_feature 164..378: est; blastn; identity 98; region 130..344
  id AA082078
  misc_feature 36..165: est; blastn; identity 99; region 1..130; id AA082078; est
acttagtcgtgtgtacatcattgggaatggagggaaataaatgactggatggtcgctgctttttaagtttcaaattgacattccagacaagcggtgcctgagcctgtgcctgtcttcagatcttcacagcacagttcctgggaaggtggagccaccagcctctccttgaataactgggagatgaaacaggaagctctatgacacacttgatcgaatatgacagacaccgaaaatcacgactcagccccctccagcacctctacctgttgcccgccgatcacagccggaatgcagctgaaagattccctggggcctggttccaaccgcccactgtggactctgaggcctctgcatttgtgggtggtctgcctgtgatattttggtcatgggctggtctggtc

SEQ ID NO: 511 - DNA, 335 bp, Homo Sapiens
  Uterus
  sig_peptide 24..89: Von Heijne matrix
  score 3.70
  misc_feature 70..337: seq WARKLLSVPWLLC/GP; blastn; identity 97; region 1..268
  id HSC2SG081
  misc_feature 71..251: est; blastn; identity 98; region 1..181
  id R13964
  misc_feature 256..334: est; blastn; identity 100; region 184..262
  id R13964
  misc_feature 26..255: est; blastn; identity 94; region 1..230
  id HUML13589
  misc_feature 116..251: est; blastn; identity 96; region 1..136
  id H05572
  misc_feature 256..337: est; blastn; identity 100; region 139..220; id H05572; est
aacagttacgcgccgcacggatcatggccgcagccgctctggggcagatctgggcacgaaagcttctctctgtcccttggcttctgtgtggtcccagaagatatgcctcctccagtttcaaggctgcagacctgcagctggaaatgacacagaagcctcataagaagcctggccccggcgagcccctggtgtttgggaagacatttaccgaccacatgctgatggtggaatggaatgacaagggctggggccagccccgaatccagcccttccagaacctcacgctgcacccagcctcctccagcctccactactccctgcagctgtttgagggc

SEQ ID NO: 512 - DNA, 344 bp, Homo Sapiens
  Hypertrophic prostate
  sig_peptide 48..161: Von Heijne matrix
  score 3.70
  misc_feature 57..176: seq CPLLLLVFTTNNG/RH; blastn; identity 98; region 50..169
  id AA126817
  misc_feature 219..344: est; blastn; identity 94; region 213..338
  id AA126817
  misc_feature 10..344: est; blastn; identity 96; region 2..336
  id W79731
  misc_feature 19..344: est; blastn; identity 97; region 1..326
  id H21245
  misc_feature 31..302: est; blastn; identity 96; region 34..305
  id H11314
  misc_feature 302..344: est; blastn; identity 97; region 306..348
  id H11314
  misc_feature 41..202: est; blastn; identity 98; region 22..183
  id W19587
  misc_feature 201..284: est; blastn; identity 98; region 183..266
  id W19587
  misc_feature 283..344: est; blastn; identity 96; region 266..327
  id W19587
  unsure 44: est
  position 44 of amino acid sequence
  unsure 53: Xaa =  * ,Lys; position 53 of amino acid sequence; Xaa = Ile,Leu,Val
aaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctactggtcttcaccaccaataacggccgccaccaccgaatggacgagttctcccggggaaatgtaccgtccagcgagttgcagatctacacttggatggatgcaactttgaaagaactgacaagcttagtaaaagaagtctacccagaagctagawagaagggcactcacttcaattttgcavtcgtttttacagatgttaaaagacct

SEQ ID NO: 513 - DNA, 401 bp, Homo Sapiens
  kidney
  sig_peptide 240..305: Von Heijne matrix
  score 3.70
  misc_feature 111..377: seq AVLDCAFYDPTHA/WS; blastn; identity 99; region 72..338
  id W79829
  misc_feature 370..401: est; blastn; identity 90; region 332..363
  id W79829
  misc_feature 111..377: est; blastn; identity 99; region 14..280
  id H62624
  misc_feature 370..401: est; blastn; identity 90; region 274..305
  id H62624
  misc_feature 111..377: est; blastn; identity 99; region 24..290
  id H81957
  misc_feature 111..376: est; blastn; identity 92; region 59..324
  id W82998
  misc_feature 111..376: est; blastn; identity 92; region 64..329; id AA023811; est
actagcctgcgagtgttctgagggaagcaaggaggcggcggcggccgcagcgagtggcgagtagtggaaacgttgcttctgaggggtgtccaagatgascggttckamcggagktcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgatccaacgcatgcctggagtggaggactagatcatcaattgaaaatgcatgatttgaacactgatcaagaaaatcttgttgggaccatgatgcccctatcagatgtgttg

SEQ ID NO: 514 - DNA, 275 bp, Homo Sapiens
  Uterus
  sig_peptide 12..269: Von Heijne matrix
  score 3.70
  misc_feature 87..272: seq WAVVLADTAVTSG/RG; blastn; identity 98; region 72..257
  id T60345
  misc_feature 47..89: est; blastn; identity 100; region 33..75
  id T60345
  misc_feature 14..47: est; blastn; identity 97; region 1..34
  id T60345
  misc_feature 87..272: est; blastn; identity 96; region 75..260
  id T46853
  misc_feature 12..89: est; blastn; identity 98; region 1..78
  id T46853
  misc_feature 87..207: est; blastn; identity 97; region 39..159
  id R57601
  misc_feature 193..272: est; blastn; identity 92; region 144..223
  id R57601
  misc_feature 48..89: est; blastn; identity 92; region 1..42
  id R57601
  misc_feature 84..195: est; blastn; identity 90; region 55..166
  id W71083
  unsure -52: est; position -52 of amino acid sequence; Xaa = Ala,Glu
ataggcgcaagatggcgctgctttttgcacgttctttgcgcttgtgccgctggggagccaaacgattgggagttgcctccacagaggcccagagaggcgtcagtttcaaactggmagaaaaaaccgcccacagcagcctggcactcttcagagatgatacgggtgtcaaatatggcttggtgggattggagcccaccaaggtggccttgaatgtggagcgcttccgggagtgggcagtggtgctggcagacacagcggtcaccagtggcagaggg

SEQ ID NO: 515 - DNA, 397 bp, Homo Sapiens
  Umbilical cord
  sig_peptide 77..280: Von Heijne matrix
  score 3.60
  seq ILLGNYCVAVADA/KK
  misc_feature 102: n=a, g, c or t
  unsure -60: position -60 of amino acid sequence; Xaa = Ala,Glu,Gly,Leu,Pro,Gln,Arg,Val
attcccccttgggcggtggtggaggtggtaaccgtgatagtagcagctccggcggcagcaacagcgactacgagggatggcggcggctgcagcaggaactsnaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaactttttacagaaggacgggg

SEQ ID NO: 516 - DNA, 381 bp, Homo Sapiens
  kidney
  sig_peptide 139..318: Von Heijne matrix
  score 3.50
  misc_feature 78..379: seq WFYIGSSLNGTRG/KR; blastn; identity 98; region 79..380
  id H17763
  misc_feature 2..53: est; blastn; identity 100; region 4..55
  id H17763
  misc_feature 96..377: est; blastn; identity 98; region 82..363
  id H16532
  misc_feature 2..53: est; blastn; identity 98; region 7..58
  id H16532
  misc_feature 79..370: est; blastn; identity 98; region 46..337
  id R52491
  misc_feature 66..248: est; blastn; identity 96; region 65..247
  id R21494
  misc_feature 2..53: est; blastn; identity 100; region 1..52
  id R21494
  misc_feature 266..305: est; blastn; identity 97; region 268..307
  id R21494
  misc_feature 129..321: est; blastn; identity 99; region 71..263
  id AA084554
  misc_feature 315..379: est; blastn; identity 96; region 256..320; id AA084554; est
agtggcccggatgttcggtgcagctgccagatccgctgatctagtgcttctcgaaaaaaaccttcaggcggcccatggctgtcgatattcaaccagcatgccttggactttattsygggaagaccctattatttaaaaatggctcaactgaaatatatggagaatgtggggtatgcccaagaggacagagaacgaatgcacagaaatattgtcagccttgcacagaatctcctgaactttatgattggctctatcttggatttatggcaatgcttcctctggttttacattggttcttcattgaatggtactcggggaaaaagagttccagcgcacttttccaacacatcactgcattatttgaatgcagcatggccgcgg

SEQ ID NO: 517 - DNA, 293 bp, Homo Sapiens
  Brain
  sig_peptide 174..266: Von Heijne matrix
  score 3.50
  misc_feature 3..294: seq WSPLSTRSGGTHA/CS; blastn; identity 98; region 1..292
  id HUM524F05B
  misc_feature 44..172: est; blastn; identity 99; region 48..176
  id H81799
  misc_feature 167..276: est; blastn; identity 96; region 170..279
  id H81799
  misc_feature 14..48: est; blastn; identity 97; region 16..50
  id H81799
  misc_feature 48..172: est; blastn; identity 99; region 57..181
  id T84779
  misc_feature 167..226: est; blastn; identity 93; region 175..234
  id T84779
  misc_feature 1..45: est; blastn; identity 97; region 7..51
  id T84779
  misc_feature 167..294: est; blastn; identity 94; region 101..228
  id W81213
  misc_feature 66..172: est; blastn; identity 98; region 1..107
  id W81213
  misc_feature 8..172: est; blastn; identity 98; region 1..165
  id AA090080
  misc_feature 167..210: est; blastn; identity 93; region 159..202; id AA090080; est
aaaaacaataggacggaaacgccgaggaacccggctgaggcggcagagcatcctggccagaacaagccaaggagccaagacgagagggacacacggacaaacaacagacagaagacgtactggccgctggactcckctgcctcccccatctccccgccatctgcgcccggaggatgagcccagccttcagggccatggatgtggagccccgcgccaaaggstccttctggagccctttgtccaccaggtcggggggcactcatgcgtgctccgcttcaatgagacaaccctgg

SEQ ID NO: 518 - DNA, 347 bp, Homo Sapiens
  Substantia nigra
  sig_peptide 18..179: Von Heijne matrix
  score 3.50
  misc_feature 26..326: seq SILAQVLDQSARA/RL; blastn; identity 99; region 42..342
  id R71425
  misc_feature 19..345: est; blastn; identity 97; region 11..337
  id AA133412
  misc_feature complement(114..345): est; blastn; identity 98; region 172..403
  id AA156940
  misc_feature complement(71..114): est; blastn; identity 100; region 402..445
  id AA156940
  misc_feature complement(26..76): est; blastn; identity 92; region 439..489
  id AA156940
  misc_feature 172..345: est; blastn; identity 97; region 186..359
  id W07240
  misc_feature 72..171: est; blastn; identity 98; region 83..182
  id W07240
  misc_feature 21..76: est; blastn; identity 92; region 33..88
  id W07240
  misc_feature 39..345: est; blastn; identity 98; region 1..307
  id R81019
  est
  misc_feature 335: n=a, g, c or t
  unsure 52: position 52 of amino acid sequence; Xaa = Ile,Lys,Met,Asn,Thr
agcgctgacgccgagccatggcggacgaggagcttgaggcgctgaggagacagaggctggccgagctgcaggccaaacacggggatcctggtgatgcggcccaacaggaagcaaagcacagggaagcagaaatgagaaacagtatcttagcccaagttctggatcagtcggcccgggccaggttaagtaacttagcacttgtaaagcctgaaaaaactaaagcagtagagaattaccttatacagatggcaagatatggacaactaagtgagaaggtatcagaacaaggtttaatagaratccttaaaaaagtaagccaacaaacagaaaagahnacaacagtgagg

SEQ ID NO: 519 - DNA, 414 bp, Homo Sapiens
  Cancerous prostate
  sig_peptide 157..345: Von Heijne matrix
  score 3.50
  misc_feature 186..382: seq GLVCAGLADMARP/AE; blastn; identity 97; region 156..352
  id AA082259
  misc_feature 61..146: est; blastn; identity 93; region 34..119
  id AA082259
  misc_feature 29..61: est; blastn; identity 96; region 1..33
  id AA082259
  misc_feature 194..331: est; blastn; identity 97; region 169..306
  id H80945
  misc_feature 54..146: est; blastn; identity 93; region 30..122
  id H80945
  unsure 10: est; position 10 of amino acid sequence; Xaa = Ala,Asp,Glu,Gly
aacagcgggcagggaaagccgcgggaagggtactccaggcgagaggcggacgcgagtcgtcgtggcaggaaaagtgactagctccccttcgttgtcagccagggacgagaacacagccacgctcccamccggctgcchaagrwtccctsggcggcgatgtcggccgccggtgcccgaggcctgcgggccacctaccaccggctcctcgataaagtggagctgatgctgcccgagaaattgaggccgttgtacaaccatccagcaggtcccagaacagttttcttctgggctccaattatgaaatgggggttggtgtgtgctggattggctgatatggccagacctgcagaaaaacttagcacagctcaatctgvkgttttgatggctacagggtttatttggtcaagatactcg

SEQ ID NO: 520 - DNA, 478 bp, Homo Sapiens
  Muscle
  sig_peptide 98..355: Von Heijne matrix
  score 3.50
  misc_feature 196..391: seq TGXLNMTLQRASA/AP; blastn; identity 95; region 185..380
  id W07314
  misc_feature 58..204: est; blastn; identity 98; region 46..192
  id W07314
  misc_feature 409..478: est; blastn; identity 98; region 401..470
  id W07314
  misc_feature 34..412: est; blastn; identity 97; region 12..390
  id W07582
  misc_feature 45..393: est; blastn; identity 98; region 31..379
  id W73850
  misc_feature 16..52: est; blastn; identity 94; region 1..37
  id W73850
  misc_feature 73..447: est; blastn; identity 99; region 1..375
  id AA112776
  misc_feature 63..388: est; blastn; identity 99; region 1..326
  id H72671
  est
  misc_feature 323: n=a, g, c or t
  unsure -11: position -11 of amino acid sequence; Xaa = Ala,Phe,Ile,Leu,Pro,Ser,Thr,Val
aacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacagganytttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaat

SEQ ID NO: 521 - DNA, 355 bp, Homo Sapiens
  Uterus
  sig_peptide 245..298: Von Heijne matrix
  score 3.50
  misc_feature 4..333: seq LLGLELSEAEAIG/AD; blastn; identity 99; region 1..330
  id N35568
  misc_feature 26..297: est; blastn; identity 98; region 1..272
  id R35915
  misc_feature 295..338: est; blastn; identity 100; region 271..314
  id R35915
  misc_feature 44..255: est; blastn; identity 99; region 1..212
  id W31312
  misc_feature 251..355: est; blastn; identity 98; region 209..313
  id W31312
  misc_feature 21..328: est; blastn; identity 99; region 13..320
  id HSC1MA011
  misc_feature 62..339: est; blastn; identity 97; region 1..278; id R61491; est
attcgtttacagttcggcacgtaggacggagggtagtgcgtctagagacacatattcccaacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacattgagggtctcgaggacgcctagatctctttcccagggccatggcgaacccgaagctgctgggactggagctaagcgaggcggaggcgatcggtgctgattcggcgcgatttgaggagctgctgctgcaggcctcgaaggagctccagcaa

SEQ ID NO: 522 - DNA, 401 bp, Homo Sapiens
  brain
  sig_peptide 204..323: Von Heijne matrix
  score 3.50
  misc_feature 113..201: seq ALLCTLLLHFQNI/RR; blastn; identity 100; region 90..178
  id W21198
  misc_feature 23..74: est; blastn; identity 98; region 2..53
  id W21198
  misc_feature 71..111: est; blastn; identity 100; region 49..89
  id W21198
  misc_feature complement(114..201): est; blastn; identity 94; region 271..358
  id AA061731
  misc_feature complement(114..201): est; blastn; identity 94; region 271..358
  id AA061768
  misc_feature complement(125..201): est; blastn; identity 96; region 269..345
  id AA058174
  unsure 17: est; position 17 of amino acid sequence; Xaa = Phe,Ser,Tyr
aaaggtgtctggatcggagggaggttcgggtgggcatcgggcggctggaagagctcgactcgtcccgctgggaaagcgcgagtctgagtggaaccctggacgacttgcagagcggctggcgcagtcatggcggactactggaagtcacagccaaagaaattctgtgattactgcaagtgctggatagcagacaataggcctgtatgataattccgctgttagagattctaataataattgtgttgaatgaagtgctcctttttgatgtaaactcagtttacaaagcacttttatgtacattgctcttgcattttcaaaacatcagaagatttctgtcttctcagtcccctatgaaagctgtgagccttctathttttcatcaacctgactttgattatata

SEQ ID NO: 523 - DNA, 385 bp, Homo Sapiens
  Lymph ganglia
  sig_peptide 80..235: Von Heijne matrix
  score 7.40
  misc_feature 50..382: seq LVFIIGLVGNLLA/LV; blastn; identity 97; region 4..337
  id HUMGPCRB
  misc_feature 292..345: vrt; blastn; identity 98; region 1..54
  id T29782
  misc_feature 345..382: est; blastn; identity 94; region 55..92
  id T29782
  unsure 40: est; position 40 of amino acid sequence; Xaa = Pro,Gln
aacttcagtttggacaactactcacagctactacacagagacccgaacgagtcactgatatacacctggaccaccaccaatggatatacaaatggcaaacaattttactccgccctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggttatttctgatatactttttaccaccgctttgcctacacgaatagctactatgcmatgggcyttgactggagaatcggagatgtgg

SEQ ID NO: 524 - DNA, 461 bp, Homo Sapiens
  Pancreas
  sig_peptide 357..443: Von Heijne matrix
  score 7.00
  misc_feature 55..462: seq SMIGIGSLPSCWA/CW; blastn; identity 99; region 1..408
  id HUMORF06
  misc_feature 47..264: vrt; blastn; identity 99; region 1..218
  id W77946
  misc_feature 263..412: est; blastn; identity 98; region 216..365
  id W77946
  misc_feature 412..462: est; blastn; identity 100; region 366..416
  id W77946
  misc_feature 54..462: est; blastn; identity 99; region 1..409
  id C16991
  misc_feature 263..462: est; blastn; identity 98; region 212..411
  id N28784
  misc_feature 102..264: est; blastn; identity 97; region 52..214
  id N28784
  misc_feature 50..107: est; blastn; identity 100; region 1..58
  id N28784
  misc_feature 54..356: est; blastn; identity 99; region 1..303
  id C17735
  misc_feature 357..462: est; blastn; identity 100; region 303..408
  id C17735
  misc_feature 102..264: est; blastn; identity 96; region 47..209
  id AA057588
  misc_feature 263..406: est; blastn; identity 98; region 207..350
  id AA057588
  misc_feature 406..462: est; blastn; identity 100; region 351..407
  id AA057588
  misc_feature 55..107: est; blastn; identity 100; region 1..53; id AA057588; est
agttcgtttattcctccgcgcgctgggacaggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggakactcatggggcattctcttctcccaccctcgggactttaccccagtgtgcaccacagagcttggcagagctgcaaagctggcaccagaatttgccaagaggaatgttaagttgwttgccctttcaatagacagtgttgaggaccatcttgcctggagcaaggatatcaatgcttacaattgtgaagagcccacagaaaagttaccttttcccatcatcgatgataggaatcgggagcttgccatcctgttgggcatgctggatccagcagaga

SEQ ID NO: 525 - DNA, 247 bp, Homo Sapiens
  Umbilical cord
  sig_peptide 152..193: Von Heijne matrix; score 11.80; seq VLVALILLHSALA/QS
aaaaccagcgccccgagttgaggcgcgggtttggtggcgcgtttcagcgaagtcgcacgtgaaggatagcagtggcctgagaaagacccagtcatggcagcctccagcatcagttcaccatggrggaaagcatgtgttcaaagccattctgatggtcctagtggcccttatcctcctccactcagcattggcccagtcccgtcgagactttgcaccaccaggccaacagaagagagaagccccgggg

SEQ ID NO: 526 - DNA, 301 bp, Homo Sapiens
  Lymph ganglia
  sig_peptide 98..160: Von Heijne matrix; score 10.00; seq LLLCLQTWPEAAG/KD
aaaatgtcgttataaaaaggaggaagaaaactcaagtgaaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagaacgg

SEQ ID NO: 527 - DNA, 384 bp, Homo Sapiens
  Lymph ganglia
  sig_peptide 76..132: Von Heijne matrix
  score 10.00
  unsure 65: seq FLLLVTAPRCILS/QV; position 65 of amino acid sequence; Xaa = Ile,Leu
aatttttccttaaattcagggtcccgctcacatgggaaatactttctgagagtcctcgacctccggcgtaagaacatgaaagacctgtggatcttcctcctcctggtgacagctcccagatgcatcctgtcccaggtgcagctgcaggagtcgggcccgcgtctagttaggccctcggagaccgtgtccctcagctgcaccgtctccggtgactccgtcagcagtggtgaccattattggacttggctccggcagccccccggggggggactggagtggattggctatatctacaccactggcaaaatcgactacaacccctcsmtcaggcgtcgagtcaccatctccgtggacacctcgaagaatcttttctccctgacacgg

SEQ ID NO: 528 - DNA, 296 bp, Homo Sapiens
  Placenta
  sig_peptide 60..122: Von Heijne matrix; score 10.00; seq LLLCLQTWPEAAG/KD
aaactgactctgctagaacagtgccgtgcttttccacagaaggttagaccctgaaagagatggctcagcaccacctatggatcttgctcctttgcctgcaaacctggccggaagcagctggaaaagactcagaaatcttcacagtgaatgggattctgggagagtcagtcactttccctgtaaatatccaagaaccacggcaagttaaaatcattgcttggacttctaaaacatctgttgcttatgtaacaccaggagactcagaaacagcacccgtagttactgtgacccacatg

SEQ ID NO: 529 - DNA, 232 bp, Homo Sapiens
  Lymph ganglia
  sig_peptide 59..115: Von Heijne matrix
  score 9.90
  seq FLFVVAAATGVQS/QV
  misc_feature 53: n=a, g, c or t
atcacataacatccacatctctcctctgaagaaggccctgggagcgcastcantcaccatggactggacctggaggttcctctttgtggtggcagcagctacaggtgtccagtctcaggttcaactggtgcaatctggggctgaggtggtgaagcctgggtcctcggtaaaggtctcctgtaagacttctggagacggtttcagcaaatatccaatcaactgggtgcaaggg

SEQ ID NO: 530 - DNA, 290 bp, Homo Sapiens
  Lymph ganglia
  sig_peptide 105..161: Von Heijne matrix; score 9.60; seq GLLLLCLLPHRLA/LV
acaccatdtgctttagtttcagtcctcgtatcatagaaaagttcatgtcataaaagaagttaaaaccactcttgaataattggaacccttatgccaattgtctaatgtcaatttgttttctgggattgcttcttctatgtcttcttcctcatcgtctggcactggttcagaaacactcatctccatcaagtcgtcttctgctaattcctgtggtgcagtgtctactagctcttgaatttctccaagatccatatcttgatatcttcaacctgcccctgcccccaccttgg

SEQ ID NO: 531 - DNA, 213 bp, Homo Sapiens
  Lymph ganglia
  sig_peptide 148..198: Von Heijne matrix; score 9.20; seq LVLLILPLLSSLS/KV
atttctctaaacagcttgttacatgttccttttaagttcagtcaaattgcataggaacttatttttaagtagaagatagattctgaagctttatgtatacggattaaaaattgaggctaaaatttgatcttattttaactttataatatgataggatttctagtgcttttaatacttcctctcctttcttccttatccaaagtcagctccaag

SEQ ID NO: 532 - DNA, 175 bp, Homo Sapiens
  Lymph ganglia
  sig_peptide 59..151: Von Heijne matrix
  score 8.90
  unsure -18: seq LLMSLLVSTVTWQ/IS; position -18 of amino acid sequence; Xaa = Ala,Ser
atttttttaacattgtcaagctttatatcatgttatttcccaagtataattcacatggatgcagtgcttactttcagtccttatggcacagtttattkctcatttcttatctttattaatgtctttgttggtgagtacagtcacttggcagatctcccgcaccccctggcatggg

SEQ ID NO: 533 - DNA, 341 bp, Homo Sapiens
  Lymph ganglia
  sig_peptide 81..137: Von Heijne matrix
  score 8.90
  unsure 56: seq WIFFLATLKGVQC/QV; position 56 of amino acid sequence; Xaa = Phe,His,Ile,Leu,Asn,Tyr
acctctgggagaggagccccagccctgagatccccgggtgtttccattcagcgaccagcactgaacacagaggactcaccatggagttgggactgagctggatcttcttcttggctactttaaaaggtgtccaatgtcaggtgaggctgctggagtctgcgggaggcctgcaagagcctggcggggccctgagactctcctgtgcagtcagtggcttcatcttcaatgacttcgccatgcattgggtccgccagacgccagggaagggcctggagtgggtcgcaggcataaattgggatggchwcattttagggtatgcggactctgtgaagggccgcagg

SEQ ID NO: 534 - DNA, 195 bp, Homo Sapiens
  Lymph ganglia
  sig_peptide 19..63: Von Heijne matrix; score 8.60; seq SVSLALLSGWVGS/RQ
accctttccctgttagacatggtaagtgtgagtttagcgctgctgtccggatgggttggtagcagacagggtagagtagggttaagcacactggtcaccttaggattggtttcctggtgctggagaatggttaggacacaggccttggaaggttttttgagtgtgaaatattactcagcgttttctgcagaccag

SEQ ID NO: 535 - DNA, 342 bp, Homo Sapiens
  Placenta
  sig_peptide 172..234: Von Heijne matrix; score 8.50; seq LPLLLSWVAGGFG/NA
agcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagc

SEQ ID NO: 536 - DNA, 377 bp, Homo Sapiens
  Lymph ganglia
  sig_peptide 36..275: Von Heijne matrix
  score 8.40
  seq FVVFSLFLICAMA/GD
  misc_feature 338: n=a, g, c or t
  unsure -48: position -48 of amino acid sequence
  unsure 20: Xaa = Arg,Thr
  position 20 of amino acid sequence
  unsure 21: Xaa = Phe,Ser
  position 21 of amino acid sequence
  unsure 26: Xaa = Phe,Leu
  position 26 of amino acid sequence
  Xaa = Gly,Val
  unsure 27: Xaa = Ala,Pro
  unsure 32: position 32 of amino acid sequence
  unsure 33: Xaa = Arg,Ser; position 33 of amino acid sequence; Xaa = Ile,Leu
agcagaaaactaactgaaaaacgagaacctactgtatggttagtaatttcttccatgtcatacaagtattcgagaaatctgctaccttgattagtaagactgaacacattggttttgtcatttattcatggasgaagtccaccacccacttggggagcagaaggaaatttgccatctcaatttacttatcagaagtttctttgcagaaatatgattgtcccttcagtgggacatcatttgtggtcttctctctctttttgatctgtgcaatggctggagatgtagtctacgctgacatcaaaactgttcggacttccccgttagaactcgcgtytttncttcagagatctgkgsctttcaacttttctagbmtccgg

SEQ ID NO: 537 - DNA, 240 bp, Homo Sapiens
  Lymph ganglia
  sig_peptide 1..132: Von Heijne matrix
  score 8.20
  seq ICLACVLFPLLRT/SD
  misc_feature 8..9: n=a, g, c or t
  unsure -42: position -42 of amino acid sequence; Xaa = His,Leu,Pro,Gln,Arg
atgcgacnnttttggtttctcatgtacccctttcgcttccatgactgcaaacagaaatatgacctgtacatcagcattgctggctggctgatcatctgccttgcctgtgtactctttccactcctcagaaccagtgatgatacccctggcaataggaccaaatgctttgtggatcttcctaccaggaatgtcaacctggcccagtccgttgttatgatgaccattggcgagttgattggg

SEQ ID NO: 538 - DNA, 193 bp, Homo Sapiens
  Lymph ganglia
  sig_peptide 2..52: Von Heijne matrix
  score 7.00
  seq CCLFTCFFIPCIS/CK
  misc_feature 134: n=a, g, c or t
  unsure 28: position 28 of amino acid sequence; Xaa = Phe,Ile,Leu,Val
catggtttccttatgttgtcttttcacttgtttctttattccttgtatttcctgtaagctagaaatgtggggactcgatgagcctaaagttaaaccattctggcaagaatgcgtcctaggggatgttgtgggcntcatcctgcagcacaggaggcagcccccggtgccacgttccatactagtaatgggggcc

SEQ ID NO: 539 - DNA, 146 bp, Homo Sapiens
  Placenta
  sig_peptide 57..137: Von Heijne matrix; score 6.90; seq ILLLVTYSPIAYS/HS
agcaggcagcctgtgccttttctccaaacgaagacagcactttgaaaattctttcaatggatttttttttccttgaaagatcgtactgggggaaaatgatacttctattagttacatattctccaatcgcatactcgcactcccgg

SEQ ID NO: 540 - DNA, 334 bp, Homo Sapiens
  Lymph ganglia
  sig_peptide 170..247: Von Heijne matrix
  score 6.90
  unsure 11: seq LWVLLLCAHVVTL/LV; position 11 of amino acid sequence; Xaa = Ile,Thr
atttttcctgtggtgggttcacacgcagctagacacagctaacttgagtcttggagctcctagagggaagcttctggaaaggaaggctcttcaggacctcttaggagccagagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagaccaycacagctgcsactgcctcagttagaagcacaaaggacccctgccccacccagggg

SEQ ID NO: 541 - DNA, 254 bp, Homo Sapiens
  Lymph ganglia
  sig_peptide 78..221: Von Heijne matrix; score 6.80; seq ILRMLLSLQPVLQ/DA
atagcaattgggtacgtgttgaagagcgtgactgttgcaatgactgctaccttgcattagaacatgggcgtcagttcatggataacatgtcaggaggaaaagttgatgaagcacttgtgaaaagttcatgcttacacccctggtccaaaagaaacgatgtgagtatgcagtgctcacaggatatacttcgaatgctcctctctcttcagccagttcttcaggatgccattcagaaaaaaagaacagtaagacag

SEQ ID NO: 542 - DNA, 181 bp, Homo Sapiens
  Lymph ganglia
  sig_peptide 5..139: Von Heijne matrix
  score 6.70
  unsure -44: seq AALVLWTLPGAQR/RG
  position -44 of amino acid sequence
  unsure -19: Xaa =  * ,Arg; position -19 of amino acid sequence; Xaa = Leu,Arg
aaggatgygactgcaaggccaggaagctacagggaaagttctgatcaaaatacacaaagacacaagccaggtccccaccgcgckwggcgatgcatccatagcagccttggtgctgtggacactccctggggcccagcgaaggggagagtttgctcccaaaggcgcaccaatgaccaacagg

SEQ ID NO: 543 - DNA, 108 bp, Homo Sapiens
  Lymph ganglia
  sig_peptide 22..96: Von Heijne matrix; score 6.60; seq ILVLILFPTSCVM/QV
aacctacacaatgatagtgtaatgactgagcactcactgacgcatcaagggatcccaattctagtcttgattctatttccaactagttgtgtcatgcaagtcctctgg

SEQ ID NO: 544 - DNA, 213 bp, Homo Sapiens
  Lymph ganglia
  sig_peptide 118..174: Von Heijne matrix; score 6.50; seq RFIFLTSLQLISS/SY
aaatcttgaagtgtattgttgaatcatagatgtttttatgtggctatctattccttacttaatccttcattttcaagaagattgtgtcgtwaaagcccttaaaatttggtaccctttatgtacattggtggtctgagattcatttttctcacctctttacaactaatttcaagcagctatgttaccactttattaaaaaaaaacacacttagg

SEQ ID NO: 545 - DNA, 227 bp, Homo Sapiens
  Lymph ganglia
  sig_peptide 105..218: Von Heijne matrix; score 6.50; seq LIFFSLIFLNLFA/IS
atgattaaagaaatgatcttttaaagcaaaattgtttgctgtagccagtgacagcttatttaaagaaagtgtttaacttatttgattttagcatgttttagtaaatgtctgttagtcttaaacacattcacttgcattttattattatgtcggtacttgtattttggaactgtagtcatttgattttcttttccttgatttttttaaacctgtttgcgatctcctgg

SEQ ID NO: 546 - DNA, 186 bp, Homo Sapiens
  Lymph ganglia
  sig_peptide 106..171: Von Heijne matrix
  score 6.30
  seq MVSFLSXPFLCSA/KP
  misc_feature 9: n=a, g, c or t
  unsure -21: position -21 of amino acid sequence
  unsure -20: Xaa = Lys,Asn,Arg,Ser
  position -20 of amino acid sequence
  unsure -17: Xaa = Arg,Thr
  position -17 of amino acid sequence
  unsure -16: Xaa = Ile,Asn,Ser
  position -16 of amino acid sequence
  unsure -7: Xaa = Cys,Phe; position -7 of amino acid sequence; Xaa = His,Ile,Leu,Asn
aagcycmgnyatccttggaaataacctcaaaargccttaggctaatgcacagggttcttccttctagttctgactcaccttcctgacctcattttatgcctcactatgardasacttggtadttktagatttatggtctctttcctatcamwcccctttctttgttcagcaaaaccatcctccggg

SEQ ID NO: 547 - DNA, 267 bp, Homo Sapiens
  Lymph ganglia
  sig_peptide 55..111: Von Heijne matrix
  score 6.30
  seq ILVSVAAATGAHS/QL
  misc_feature 7: n=a, g, c or t
acccahnyaccacacccctccttgggagaatcccctggatcacagctcctcaccatggactggacctggtacatccttgtctcggtggcagcagcaacaggtgcccactcccaacttcagctgctgcagtctggaagtgacatcaagaagcctggggcctcaatgaacgtctcctgcaaggcatctggcggcagtattagcacccgtggaattagttgggtccgacaggtccctggacaggggcttgagtggatgggatggatcggg

SEQ ID NO: 548 - DNA, 259 bp, Homo Sapiens
  Lymph ganglia
  sig_peptide 92..226: Von Heijne matrix
  score 6.30
  seq VACVLSSLIAVNS/AH
  misc_feature 185..186: n=a, g, c or t
  unsure -14: position -14 of amino acid sequence; Xaa =  * ,Ala,Glu,Gly,Lys,Leu,Met,Pro,Gln,Arg,Ser,Thr,Val,Trp
aaagcagystaccttgtatgggcagtggagcaagctaaggagacacaggagatatatgggaacctaaagtggaattttcaaattcttgctcatgatttcaaaattctcttcaaaggcgtactctgtaaggggcttagagctcttctccctattgcctattaacccatccccaaacagtgccattnnggtagcttgtgtgctctcttctcttattgctgttaactcagctcacccagaaagtactattgacacccgctgg

SEQ ID NO: 549 - DNA, 165 bp, Homo Sapiens
  Umbilical cord
  sig_peptide 76..159: Von Heijne matrix; score 6.30; seq LLFLIFSLNLNRG/VG
agatgtccataattattggtaactcagttaccttctaactaataggctggttcaggagactctcccagtttataaatggttctcttgggagcctttggaagctgtattaaatctttcagtcttttatttctaattttttctcttaatctaaatagaggcgtcggg

SEQ ID NO: 550 - DNA, 388 bp, Homo Sapiens
  Lymph ganglia
  sig_peptide 74..178: Von Heijne matrix
  score 6.30
  unsure -4: seq ALKLLLSPGXSGS/SS; position -4 of amino acid sequence; Xaa = Gly,Arg
aacttaacatggcggcggcggcgcactgccgaggcgcctgagcgggtcgcgagcgtggtgttacactccagtcatggcggcccgacaggccgtgggcagcggggctcaggagacatgcggtctggatcggattttggaggcattgaagctgctgctgagcccgggmsgctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttg

SEQ ID NO: 551 - DNA, 282 bp, Homo Sapiens
  Lymph ganglia
  sig_peptide 118..174: Von Heijne matrix; score 6.20; seq LALFLMALGFSCI/HK
attgtaayaaaaatatttactactcttactggacttagtttcctttttgtggtttctgttacgtggtctataagtttcaagcagtgagcttaatttgtgcgtcataaaaatttggttatgagtacacagaagggacttgctctgtttctcatggcccttggcttttcatgcatacacaagaagtttcaggagtcagaggagggtaagcaccatatgggtggaattaataggtctcattgggttaagtctcgaaagagctgtttaataaatagccaacgcaag

SEQ ID NO: 552 - DNA, 147 bp, Homo Sapiens
  Lymph ganglia
  sig_peptide 67..141: Von Heijne matrix; score 6.10; seq YFLIVFFVFLCNC/HQ
acagacatttcatactggccatcttgatgtagattacattgccatcctgtgtcctgattgtactttatgaaagatgtagaaataatcatgatatttcacggttatttcttgattgtgttttttgtgttcctatgcaactgccaccag

SEQ ID NO: 553 - DNA, 345 bp, Homo Sapiens
  Lymph ganglia
  sig_peptide 214..339: Von Heijne matrix; score 6.10; seq AILLLQSQCAYWA/LP
aarttgagcttggggactgcagctgtggggagatttcagtgcattgcctcccctgggtgctcttcatcttggatttgaaagttgagagcagcatgttttgcccactgaaactcatcctgstgrsagtgtamtggattattccttgggcctgaatgacttgaatgtttccccgcctgagctaacagtccatgtgggtgattcagctctgatgggatgtgttttccagagcacagaagacaaatgtatattcaagatagactggactctgtcaccaggagagcacgccaaggacgaatatgtgctatactattactccaatctcagtgtgcctattgggcgcttcca

SEQ ID NO: 554 - DNA, 253 bp, Homo Sapiens
  Lymph ganglia
  sig_peptide 155..223: Von Heijne matrix; score 6.10; seq SSILSTFVSWLSA/FY
aatataatttgatatataaatatacttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctcgggg

SEQ ID NO: 555 - DNA, 350 bp, Homo Sapiens
  Lymph ganglia
  sig_peptide 39..134: Von Heijne matrix
  score 6.10
  unsure -30: seq LPLLTSALHGLQQ/QH; position -30 of amino acid sequence; Xaa = Ala,Ser
agccccagatcctgaaggaggtgcagagcccagaggggatgatckcgctgagggacacagctgcctccctccgccttgagagagacacaaggcagttgccactgctcaccagtgccctgcacggactgcagcagcagcacccagccttctctggtgtggcacggctggccaagcggtgggtgcgtgcccagcttcttggtgagggtttcgctgatgagagcctggatctggtggccgctgcccttttcctgcaccctgagcccttcacccctccgagttccccccaggttggcttccttcgattccttttcttggtatcaacgtttgattggaagaacaaccccctcggg

SEQ ID NO: 556 - DNA, 315 bp, Homo Sapiens
  Lymph ganglia
  sig_peptide 265..306: Von Heijne matrix; score 5.90; seq ITMMLALISVCLF/AF
actaatttgaagtcataccagcttgacttagataacatacaaaattctgttcctttttcagttgttgatgtaacaaaattacatctttatacattgtgtacacaacaacataagctaataatttaatacactcatttcttaaattgtagaaaacaaaattgggcttaccaatcaaattacaataatatgagattttaaatttgtaatttaaaaaaatattagtttcttaaatcatgtagaaaacaaaaagtaaagtcacacatcatgattacaatgatgttagctcttataagtgtctgcctatttgcvttttgg

SEQ ID NO: 557 - DNA, 346 bp, Homo Sapiens
  Umbilical cord
  sig_peptide 191..235: Von Heijne matrix; score 5.90; seq LLTLVQCSDLCPS/CS
actgacattgrttatccaraatgactaacactcttctacattaaatagggaaagagcctgattacagtccctccaacagtctacacaaataccccccaacacacacrtatrattgagggtgaagtgttttctagatcattgcctaagtcccccatttgctttcagaatagacccaggcrrgtaaaagggaatgtggctcttaacactagttcaatgttctgacctktgtccttcctgctcccaagcattgacacttgtgttagtatctttttctgaagtcagagacttggcagagacctccctatcatctaatctgaagaactctttgtttatagttctgaagagg

SEQ ID NO: 558 - DNA, 179 bp, Homo Sapiens
  Lymph ganglia
  sig_peptide 27..119: Von Heijne matrix; score 5.90; seq LLFACLTMLLVKT/CQ
attaccagtgtacacttgagagagctatgagagtacatcttttcccatacctttgtcaacctagtgtactatcaaactttttgttatttgcttgtcttactatgttgttggtgaaaacgtgtcaggagtccccaaaatcacccctaagtttgatgatttgccagacttatagaattggg

SEQ ID NO: 559 - DNA, 261 bp, Homo Sapiens
  Lymph ganglia
  sig_peptide 121..165: Von Heijne matrix; score 5.70; seq PLCFLILPYPVLS/SH
atttygggtctacgcattctgctactactcctgttttcctctacaacgtcccatctttatcctagtgatgtgtcctacttacaacatatatactccatctccagcctcagcagccctgtcatgattcccctctgtttcctcatcttaccctatcccgtgctttcctctcatgaccataattccctcggtctcttagctgacaaagtagccaatgaaattaaccgaagtaattgccgggtctatgcccattcccactccggg

SEQ ID NO: 560 - DNA, 144 bp, Homo Sapiens
  Umbilical cord
  sig_peptide 28..123: Von Heijne matrix
  score 5.50
  unsure -17: seq CLLSXPSTRKSQA/CM
  position -17 of amino acid sequence
  unsure -9: Xaa = Ala,Glu,Pro,Gln; position -9 of amino acid sequence; Xaa = Ile,Leu
acctgctctagcgggccgcgtagaccaatggcgggctcccggctcccgcggcagctcttcctccagggcgtgsmggcgtcttcatgtttgctttcrmttccctctacacgcaaatcccaggcctgtatggccccgagggcatgg

SEQ ID NO: 561 - DNA, 250 bp, Homo Sapiens
  Lymph ganglia
  sig_peptide 146..229: Von Heijne matrix
  score 5.40
  seq FVLHLLAQDLVCC/FY
  misc_feature 246..247: n=a, g, c or t
  unsure 6: position 6 of amino acid sequence
  unsure 7: Xaa =  * ,Cys,Phe,Leu,Ser,Trp,Tyr; position 7 of amino acid sequence; Xaa =  * ,Glu,Gln
atggcctttatttctgttcttactccaacattttctcatcttttctcccatccttttacttagaaaaatgttaaaattagaggaaatagtacaatgaacatgagtattctctttaatcttattcaattaatatatttctctgtatatgtatatatgcttttgtttggaatcatttgaaattaagtgtggatttgttctccatcttcttgctcaggatttggtgtgctgcttttatctgaggacatnnbar

SEQ ID NO: 562 - DNA, 231 bp, Homo Sapiens
  Lymph ganglia
  sig_peptide 127..186: Von Heijne matrix; score 5.40; seq LNAFTLLVWLSLS/KN
attttaatataatgcattaaaatgtcaggtaatactgtatattctatattgcatcacaacaggagatatatctggatgacctaccattagtgatgctaagttttacattgtattggagcaacaccaatgcatttcatcctccataaccttaatgcttttactctcctagtttggctatctctttctaaaaatacagttcccagaccagcagtattagcatcggcagcctgg

SEQ ID NO: 563 - DNA, 194 bp, Homo Sapiens
  Lymph ganglia
  sig_peptide 84..188: Von Heijne matrix; score 5.20; seq IAPLFTLLPKSIP/AP
acactcattctatactgggcaccatgtctgatcatttttttttctgatatttggatcagttctattaaactgataaccctgtgatgtctttttttcccttcaatagatctttaaattccaatcctcaccctaatctactctttcccaatatagcaccgttattcacactgctcccaaaatctattccagccccg

SEQ ID NO: 564 - DNA, 169 bp, Homo Sapiens
  Umbilical cord
  sig_peptide 8..76: Von Heijne matrix; score 5.20; seq LLDLHCFCSLAKT/KN
aaacagaatggttgtatgggtacttgaagtacggtttctcctggatttgcattgcttttgcagccttgcaaagacaaaaaatggtttaagttggggactgccacaaaaagtggcactctgcacaccctgttctgcaccggctttgttttggtttggttttcacatactg

SEQ ID NO: 565 - DNA, 351 bp, Homo Sapiens
  Lymph ganglia
  sig_peptide 223..294: Von Heijne matrix
  score 5.20
  seq PGLCCPALGSAWS/KN
  misc_feature 307: n=a, g, c or t
  unsure 5: position 5 of amino acid sequence; Xaa = Leu,Met,Val
actccctgaaccctaactcaccctttgccctccccacccttcagcccctgcccaggtcttggagatctctgtgctgtcttttgtggagcagctgctatcttgcagtcagatcctctgtcggggaggccttcagcttttgttcaacgacccagagggtgtgggaggggctcagttactcttctcctcacctggcacttagagaaagcaagtctcaagagtctcatggtatgtggttggtggacccaggggcctgtgcccggtctgtgctgtccagctttgggctctgcctggagcaaaaacaagagcntgcctgtgccgtgttgcggtccttacatggtagcgaatctcggg

SEQ ID NO: 566 - DNA, 362 bp, Homo Sapiens
  Lymph ganglia
  sig_peptide 231..308: Von Heijne matrix
  score 5.20
  unsure 8: seq FECALVSASLTTA/GT; position 8 of amino acid sequence; Xaa = Cys,Ser
aattttcaaaagtgctgttaacataaacagagcagtaaatctggggcaccatgcttttttttcaaagttgttaagaattatatcagtctgcaggtgtcacacgcagttactcagratcagawagaaggctgatcgggggttagatctccatctatctatctttttgcaaccaaccacgtccaggctgtttatttaatacttcctcttgctaatgaaggtactggttggggatgggtcgagctttcccatctcggcataagactgcaagatttgaatgtgccctggtgtcggcttcactgaccacagcaggtaccccaggcaagaatctkwgcagttataacagtgcggaggcaagacacatc

SEQ ID NO: 567 - DNA, 218 bp, Homo Sapiens
  Placenta
  sig_peptide 150..203: Von Heijne matrix
  score 5.00
  unsure -11: seq LCXXLLCVLFVSH/FY
  position -11 of amino acid sequence
  unsure -10: Xaa = Phe,Leu; position -10 of amino acid sequence; Xaa = Gly,Arg
aatytgaattgaaaattagcttcatgttgttaagatgatcatatcacctgagagagttcccaagtcyacaattgctctactagttactattcagtgtttgtsaaaaathttaatctcagtactgtgaagaagctggaaaaagggatattatggggctaaaagctctctgtttssggctgctttgtgttctttttgtctctcatttttacacacccact

SEQ ID NO: 568 - DNA, 363 bp, Homo Sapiens
  Lymph ganglia
  sig_peptide 82..309: Von Heijne matrix; score 5.00; seq FPLLALLFEKCEQ/ST
aagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcggg

SEQ ID NO: 569 - DNA, 258 bp, Homo Sapiens
  Umbilical cord
  sig_peptide 163..225: Von Heijne matrix; score 4.90; seq SVFLSGSVCLSFL/SE
atgaggttttagttctttgggcagtagcaagtagtgataggtgatggtggtctgtggttcatggaccaaaaaatgtttgagaggcatggaggatctttagacaagatcaccttctaggtgtatgtggtagcattctgttccaccgctctcttctccttcaggatgtctccctcccagctaacctgctcggtgttcctcagtgggagcgtttgccttagctttctctcagagcatcgtacttactttttctgcccactg

SEQ ID NO: 570 - DNA, 132 bp, Homo Sapiens
  Lymph ganglia
  sig_peptide 37..126: Von Heijne matrix; score 4.80; seq FCSLLCLRTQLFP/HG
aaaaacatgtcctgggttggcagcttgagatgataaatgcttcaagccctagccccggcacaccacttatgctccctgaagaggtcattctgttctcttctgtgccttcgcacacagctcttcccccacggg

SEQ ID NO: 571 - DNA, 487 bp, Homo Sapiens
  Lymph ganglia
  sig_peptide 383..424: Von Heijne matrix; score 4.80; seq LFLKYLWRSLCRG/GI
agatatttggtgtgtcgtaggctttgttgcgagtggactcttgcatcatatgtggctgttggagaattgattcccagccttttcgcctggctgagaccttgtattccagttctaggcatcacatccaactcaacagtgtccatgggaaaaagagcatctctttaaagcaagaaaaccttttccagaagcttcctgcagacctcccttcacacctcgttgaccaggctgatggtgtgtgccagtgcctaagtcaagtcattgacaacaggaagaagatgagccctggctgagttaaactgaccaggatgtgcatcccccccatgctggaagtgaggccgtcttccctgagagtcagtatccgaacagaaagatcacccaatgcatgttgtttttaaagtacttatggagatctctgtgccgtggtggtatcatccgtatgaaccatccaggctgtagtcagagaatcagagactcgctgtgtgatctc

SEQ ID NO: 572 - DNA, 296 bp, Homo Sapiens
  Lymphocytes
  sig_peptide 12..122: Von Heijne matrix; score 4.80; seq AILIRPLVSVSGS/GP
actcgctcaagatggcgctgctcgcgatgcattcttggcgctgggcggccgcggcggctgctttcgaaaagcgccggcactccgcgattctgatccggcctttagtctctgttagcggctcaggtccgcagtggaggccacatcaactcggcgccttgggaaccgctcgagcctaccagattccagagtcattaaaaagtatcacatggcagagattgggaaaaggcaattcaggacagttcttagatgctgcaaaggctctccaggtatggccactgatagaaaagaggacttgg

SEQ ID NO: 573 - DNA, 211 bp, Homo Sapiens
  Placenta
  sig_peptide 65..178: Von Heijne matrix
  score 4.80
  unsure -35: seq LASLFGLDQXAAG/HG
  position -35 of amino acid sequence
  unsure -4: Xaa = Asn,Ser
  position -4 of amino acid sequence
  unsure 4: Xaa = Ala,Gly
  position 4 of amino acid sequence
  unsure 5: Xaa = Glu,Gly; position 5 of amino acid sequence; Xaa = Phe,Leu
aacgacgtcggcggtgacaggcccgtgggactytgggratacccagcktcctccccgcaacccgatgaaagccarcgcaatgttcggtgcgggggacgaggacgacaccgatttcctctcgccgagcggcggtgccagattggcctcactttttggactggatcaggsagctgctggccatggaaatgrattkttccagtacacagcccca

SEQ ID NO: 574 - DNA, 277 bp, Homo Sapiens
  Lymph ganglia
  sig_peptide 215..253: Von Heijne matrix; score 4.70; seq MLWLLRSLTDVSS/MI
agctcttctgaaggtcaggtcatctaactcccttgacctcctccttgaagctgtgagctacttcttggcgatgcccctccatgcaggagagacttgcacttagcttcctgcttttcccctcctccccaactcctgccatgtcatttttacccatttttgtgacctcagcattgattggttggaaccacctaacgccatgtagttgaaccattcaatgctctggcttcttaggtctttaacagatgtgtcctcaatgatctttttcaccattccaggg

SEQ ID NO: 575 - DNA, 206 bp, Homo Sapiens
  Lymph ganglia
  sig_peptide 57..101: Von Heijne matrix; score 4.70; seq IFHVLIAHSSSFS/CE
aaattaaaaaaaaagtcagtgcgttttgggtatcattatagtttaaattttccttaatgacgattttccatgtgcttattgcccattcatccagcttctcttgtgaagttattgttaaggtcttttgtccatttttgggttgtttatcttttcattatctttattcacttttggagttctttattctgaatacaagtccttcgatg

SEQ ID NO: 576 - DNA, 186 bp, Homo Sapiens
  Lymph ganglia
  sig_peptide 85..129: Von Heijne matrix
  score 4.70
  unsure -9: seq WQLLXGFCGSYSA/AQ; position -9 of amino acid sequence; Xaa =  * ,Ala,Gly,Leu,Pro,Arg,Ser,Val
aactttcgctgaggwgccgaggcgacggggctttgggttwyytccattatactcatgtaatgttcttggtttgatttattcagtatgcactggcagcttttgbbaggcttctgtgggagctactcggctgcccaagccgaggcacaaaccctgccaggtctccatagtaaatacaacacgcacggg

SEQ ID NO: 577 - DNA, 308 bp, Homo Sapiens
  Umbilical cord
  sig_peptide 114..224: Von Heijne matrix
  score 4.60
  unsure -4,22: seq FVFLLFFFSXLXY/FM
  position -4, 22 of amino acid sequence
  unsure -2: Xaa = Asn,Tyr
  position -2 of amino acid sequence
  unsure 12: Xaa = Gly,Leu,Arg,Val
  position 12 of amino acid sequence
  unsure 20,21: Xaa =  * ,Cys
  position 20, 21 of amino acid sequence
  unsure 23: Xaa = Arg,Ser; position 23 of amino acid sequence; Xaa = Phe,Leu
acagctctctaaagccgagataaacctctacttgcaaagggaatttgaaaaagatgagaagccacgtgacaagtcatatcaggatgcagttttagaagatawttttragragaatgaccatgatggtgatggcttcatttctcccaaggaatacaatgtataccaacacgatgaactatagcatatttgtatttctactttttttttttagcwatttaskgtactttatgtataaaacmagtcacttttctccaagttgwatttgctatttttcccctatgagwaghwatttkgatctccccaatggg

SEQ ID NO: 578 - DNA, 438 bp, Homo Sapiens
  Umbilical cord
  sig_peptide 139..321: Von Heijne matrix
  score 4.50
  seq LVTRLALCQSPRA/GQ
  misc_feature 8..9: n=a, g, c or t
aagggagnnaggaagctgcgctgcattctgcgggacgaaccctgctccgcgcgagaatttttttgattccttcttatttggagaaatctccagctgctctgatgatagcctaagaagactgcatgctgcttcctctcgatgccaagccagaccctctcacaacctcggatctcagtccttcatggagacctggtcccagcaggaatggcagtgcaggaaattggcgcccagatggttcttccatgtgaagttgtctcgggctctgggctgacgagagaacacctggtaaccaggttagccctctgtcagtcacccagggcagggcagcatggtgcggattcagaggaggaagcttttggcatcttgcctgtgcgtcacagccaccgtctttctgcttgtcacactccaggtgaactgaggtttagtgaatggacgtgt

SEQ ID NO: 579 - DNA, 278 bp, Homo Sapiens
  Lymph ganglia
  sig_peptide 147..260: Von Heijne matrix; score 4.50; seq LLMITVTVGPGAS/GV
aagacacggacagacggacgcgcagaccttcggaaggcactgcgtaggcagcctccccggagcccacgaggctccccagcaccgttcactggtgggaggctgagccggtggaaaagacaccgggaagagactcagaggcgaccataatgtcgttacgtgtacacactctgcccaccctgcttggagccgtcgtcagaccgggctgcagggagctgctgtgtttgctgatgatcacagtgactgtgggccctggtgcctctggggtgtgcccctctggg

SEQ ID NO: 580 - DNA, 335 bp, Homo Sapiens
  Lymph ganglia
  sig_peptide 276..329: Von Heijne matrix; score 4.50; seq SLLLLGRWLTLTS/SG
aattttgghagtagagtctgtagtggtactaattaaaatagtcatgtagataaactgtttcttactgtttcaggacaagatgagtctatgccagatgtaagtcaccacactcatttactgatttcttccttgaggattttttgttgttaaaaaatttttgtggttgatctgcattctgtcttaaactctttatttcattgtggattattaacagttggtccacgggccacactttaagcaacgtcaatctctagtatccatcttagaggcaaaccatgatctatttaaccagtctcttactattgggtagatggttaaccctcacatcatctggg

SEQ ID NO: 581 - DNA, 363 bp, Homo Sapiens
  Umbilical cord
  sig_peptide 292..357: Von Heijne matrix; score 4.40; seq GFLLCPLVCGLRR/WT
aacctctcttcctttcctgagtcgttggcgcagtgactcgccacctcctccctcctcgtccccccaccggaggagttttgcggtctgtagagagctatgcagggtgagggcccctagacttcggctttcgccgctgttggtggtaggctggagttgggggtccctggatacggttttggctttacaccccctttccagcaagcttcccgtgggaatctgttccttttcaggacagctgtgatccacgtgagtaaaactgggcgttccgtcttgtgctttttcctcaggttcatgaactggaatgtaagaggcaccagaggattcctgctctgtcccctggtttgcggcttgcgacgttggaca

SEQ ID NO: 582 - DNA, 261 bp, Homo Sapiens
  Lymph ganglia
  sig_peptide 130..255: Von Heijne matrix; score 4.40; seq LVCLTFITATTHE/QP
aattgggtgcatactttttcttggtcagcatctcagtttctatttctaaagtcaaaagaagtgcctcgattcctcccaagacttgacaagcccagcagggttggtggcttctttgctgtgttgctgaaaatggaacaggctgccctggaggtggtgagccccctgccccggagatgttcagtgagatcacctgtgactacatgctgtgctaaggaccttgtgtgcctcaccttcatcactgcaacaacccatgagcagccg

SEQ ID NO: 583 - DNA, 323 bp, Homo Sapiens
  Umbilical cord
  sig_peptide 24..275: Von Heijne matrix
  score 4.40
  seq GLVQLHATXLALG/KV
  misc_feature 164: n=a, g, c or t
  unsure -5: position -5 of amino acid sequence; Xaa = Pro,Ser
aatactctcatctgtaaaatgggatgataatcccactacccagcttagtgggctgttgggaaggagggaatgggaaaggacttatggtgtctgacactacatgctggacactcgcttcctccaatgtcccatctccrtcccctgcgcccaccctggggagaggngccccctcccatactccccagaagaagcccaccatacctggtgcccgccaccgccccatcattcttcccaaggggctcgtccagctccacgccacaycactcgcccttggcaaagtctgtctcccccacgtaccgcaccacgcyagtcttcgtcccgca

SEQ ID NO: 584 - DNA, 235 bp, Homo Sapiens
  Lymphocytes
  sig_peptide 65..190: Von Heijne matrix
  score 4.30
  unsure -23: seq IQTVHIALPGSLG/HP; position -23 of amino acid sequence; Xaa =  * ,Cys,Tyr
atatggtaattamvaatatgtttatgtaccctgaatcatgtaaatatttgagctttctctaaaaatgagtatgagactatctggagaaagaatttatctcctgttagaggtttggctgccttrwctcaattttgagtcagttcttcattttatccaaactgtccacattgccctccctggaagtctgggccacccaatgggcccctgtgcctgccgcccctctttagcccacccg

SEQ ID NO: 585 - DNA, 197 bp, Homo Sapiens
  Lymph ganglia
  sig_peptide 144..191: Von Heijne matrix; score 4.30; seq LLLFCFMPVVINP/DR
atcatttggcagagaagagagaagggtatgagttgccaggtagtggatgcagatggaagcgctggtgggcccattggttgatcattggttgggaccatcttacacagaaagttcatcctattgccctttcccactgtgttaatatgggaacactccttctcttctgttttatgcctgtagtgattaacccggacaga

SEQ ID NO: 586 - DNA, 253 bp, Homo Sapiens
  Lymph ganglia
  sig_peptide 86..151: Von Heijne matrix; score 4.10; seq GIYLQLFFLSIVS/QP
agcagtgcvgaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgccg

SEQ ID NO: 587 - DNA, 358 bp, Homo Sapiens
  Lymph ganglia
  sig_peptide 212..319: Von Heijne matrix
  score 4.10
  seq HWLFLASLSGIKT/YQ
  misc_feature 9: n=a, g, c or t
atccccawnscactctctcacagagactgttcttttccttctgagaccctactccagcttgtagttctaaatctgtgattatgcactgtctgtcttcctcttgaggtcaggggccatttcttttgttctctgctatgctcaggacccagatcaaaggagctcagtaactatttacaggcgtacatcatatgtggaggacacttatgctgtgatggccccacacacagcttcctttggggtctgtcccctgctctccgttacccgcgtggtagccactgagcactggctcttcctggcttcactctctggcatcaaaacttatcagtcctacatctcagtcttttgcaaggtgactggg

SEQ ID NO: 588 - DNA, 181 bp, Homo Sapiens
  Lymph ganglia
  sig_peptide 113..172: Von Heijne matrix; score 4.10; seq SLPCLSFCTLCLV/TP
atcccatcttagctgccatcccatcctgtatgtagataccctgttcatctctctcaagatctttattctagaccttctttgtctttcttgggctccaacacctcacaccaagatgtcttacaagtggatgccctccttaccctgcttgagtttctgtaccctgtgcttggtcacccccggg

SEQ ID NO: 589 - DNA, 191 bp, Homo Sapiens
  Umbilical cord
  sig_peptide 117..182: Von Heijne matrix; score 4.10; seq LAGFLLVLYVCLP/HA
aactttgttgaaagtgagaagactggcttccgttactctcaatatgtttatttctgtgatcacccttttgtaattaatctctggtgtccaccgcccactgttacccaagtgaatgcatgcctctccccacctgggctccgaccctggcagggttcctgcttgtcttgtatgtctgtctccctcacgccggg

SEQ ID NO: 590 - DNA, 129 bp, Homo Sapiens
  Umbilical cord
  sig_peptide 31..81: Von Heijne matrix; score 4.10; seq LLDWIGLKALIRG/HD
acactatgattttataaaacaattttttctatgaacctttacttacttgactggattggactaaaagcactgatcagaggccacgacataaaaattcagtccctttgtccttccccgtgcctcccaagg

SEQ ID NO: 591 - DNA, 198 bp, Homo Sapiens
  Lymph ganglia
  sig_peptide 28..189: Von Heijne matrix
  score 4.10
  unsure -51: seq LLLFCFMPVVINP/DX
  position -51 of amino acid sequence
  unsure -49: Xaa = His,Gln
  position -49 of amino acid sequence
  unsure -46: Xaa = Asp,Glu,His,Leu,Gln,Val
  position -46 of amino acid sequence
  unsure -45: Xaa = Ala,Gly,Arg,Ser,Thr
  position -45 of amino acid sequence
  unsure -39: Xaa = Lys,Arg
  position -39 of amino acid sequence
  unsure -33: Xaa = Ser,Trp
  position -33 of amino acid sequence
  unsure 2: Xaa = Asp,Gly; position 2 of amino acid sequence; Xaa = Lys,Asn,Arg,Ser
atcatttggcagagaagagagrwgggtatgagttgccakgtaswkgatgcarssargcgctggtgggcccattsgttgatcattggwtgggrccatcttacacagaaagttcatcctattgccctttcccactgtgttaatatgggaacactccttctcttctgttttatgcctgtagtgattaacccggacarmggg

SEQ ID NO: 592 - DNA, 148 bp, Homo Sapiens
  Lymph ganglia
  sig_peptide 59..124: Von Heijne matrix; score 4.00; seq ILAFQTFLLNLRA/HL
agattacaaaaaaaaaattctcaagtgaataaagtccattgatagatattttgtttaaatggtaccaaatctgtgtggaaggcaaattttggctttccagacattcttgctgaacttgagagctcatctttttcaactggcctcccgg

SEQ ID NO: 593 - DNA, 240 bp, Homo Sapiens
  Lymph ganglia
  sig_peptide 82..123: Von Heijne matrix
  score 4.00
  seq FSLIIFFFPPSSP/XA
  misc_feature 10: n=a, g, c or t
  unsure 1: position 1 of amino acid sequence
  unsure 20: Xaa = Lys,Thr
  position 20 of amino acid sequence
  unsure 25: Xaa = Ile,Leu
  position 25 of amino acid sequence
  unsure 26: Xaa =  * ,Cys; position 26 of amino acid sequence; Xaa = His,Asn
acaacctkhntctcmcctgtatctttgtcatgtcagtcactgatatcagcatctgcccagttgctcaggccaaaaccttagatgttttccttgattattttttttttccctccctcatccccwamrgccaatccatttccatcctatcttcaaaatatattatacctgaaatttgtccatmtctcccatctatactgmmaccctccgtcagagtgtgttcatatttctagtggattacca

SEQ ID NO: 594 - DNA, 331 bp, Homo Sapiens
  Lymphocytes
  sig_peptide 242..310: Von Heijne matrix; score 4.00; seq LHCLLIVFILVEF/CK
acatccaataatcatttataaagatctctaacaggccagtcagtatacagagtaccagattaaaaataaatgtagcaccagtttttcagaaattattatgtgtctataattagggtaattacatttagaagatctttttgatgatctccttaaagtcagcaactgtctttttcatctttgtttacctagtacctggaatggagataggcgtttagcacttaaatgtttactgmatattcttatgagtgccttttatctttcctactccttgttgcattgcttacttattgtttttattttagttgagttttgtaagaaattgacttacttt

SEQ ID NO: 595 - DNA, 315 bp, Homo Sapiens
  Lymph ganglia
  sig_peptide 160..249: Von Heijne matrix
  score 4.00
  unsure -14: seq SAGVVLTMDGASA/EQ; position -14 of amino acid sequence; Xaa = His,Gln
agcaaactcttaaggtcactttctgaaggcggcctcatcacagtcggaggtatcatgatattagctggtttgacatcaagtcatttgtgagtcatcagatcttctcctgaaaatgggagacacagtagggcccctcccaggagctcttggctgttgctgatggcagaagccaagcttgtccaaggttcacttgtagcccctcagcgtcastcagctggtgtcgtcctgaccatggacggcgcgtcggccgagcaagatggcctccaggaggacagatcccacagtggcccctcgtctctccccgaggcccaccgg

SEQ ID NO: 596 - DNA, 222 bp, Homo Sapiens
  Umbilical cord
  sig_peptide 1..177: Von Heijne matrix; score 4.00; seq VLLTISTNASVLG/DG
atgaaaggagtagggcctgagcagctgaatgatggagcgccatcaaatgagattgaaatgactccatgttttttcagtgagttccttctattggacgttggtgttgttaatatagtagttattaaaatgtcttataatgtcctgttaacgattagtactaatgcctctgtacttggtgatggtgctcatagagttactactagaataagaaggccagggggg

SEQ ID NO: 597 - DNA, 464 bp, Homo Sapiens
  Umbilical cord
  sig_peptide 255..389: Von Heijne matrix; score 3.80; seq QLFWVTASTFCRS/DI
aagattaaggaaagctgccctagacaatgccatgccctcatttttcagtttcagtcattatttttctcagcagtgtccttttggcttcactgtgtcttctaacatcatcagccaaattgtttctttcttttgtaatctgtagtttcaaaataataggagttgttttgctttcagaaaaagacaattataatgttgatttggttcttttaaaaaactaaacacaccctctggagattctaatttactccgtattcatgctgaggaaactaagtgccagcaatgaaaacttgtgtctactctcaaacccctctcacaatgaggtctatttgatcagatgctgtgaatcccatcagcttttctgggtaactgccagcacattttgccgtagcgatatagctactatggctagtctcctgccatctgttcttctaatgcaactgttctcaacattttttttgaatctc

SEQ ID NO: 598 - DNA, 268 bp, Homo Sapiens
  Lymph ganglia
  sig_peptide 215..259: Von Heijne matrix; score 3.80; seq PLILLPLNPFVLQ/VA
atgatggggtgttagtaaaagtgatactagttcttgatgatggttatctctttgccttgtattcaggagttaaaaattaatgagggccttttctgaactgtaaagatatggtatttagcagttcttaatatactgagggtttctcattctctctttttgattatgttgtatttggcacatggttatttggggactacttacattcttaaattgaatgtatcctttgattctccttcctcttaacccatttgtgctgcaggttgctggg

SEQ ID NO: 599 - DNA, 440 bp, Homo Sapiens
  Lymph ganglia
  sig_peptide 240..308: Von Heijne matrix; score 3.80; seq RGFVAVGLGQISA/SP
agcaysagcamaactgacaasycgcsgcaggaagwygttgccatctccactcgttggatttctgttgctctgggttgcagcctctasgggtgagatcgtgctgactcagtctccggactttcagcctgtgactcctggcgasmgcgtcactatcacctgccgggccagtcaagacataagtyacaaattacattggtaccagcagaagcctggtcagtctccaaggctcctcgtcaaatatgcttctcagaccctctccggggtcccctcgaggtttcgtggcagtgggactgggacagatttcagcctcgccatcgatggcctgcaaactgacgattttgcaacatacttctgtcttcagagtagtagtcttccgtacacctttggtcaggggaccactctccaggtcaaacgagctgtggctgcaccatctgtcttca

SEQ ID NO: 600 - DNA, 167 bp, Homo Sapiens
  Umbilical cord
  sig_peptide 93..146: Von Heijne matrix; score 3.80; seq ATACGPAAHQCSA/VP
aatactaattcctaccagtcctcacgaggagggtgacacacaccctgttcccacttgagagagggcatctgcaggggtggaggggagaccccatggctcggcctggtgccacagcctgcgggcctgccgcccaccagtgctctgcggtcccactgtggtcccctggg

SEQ ID NO: 601 - DNA, 259 bp, Homo Sapiens
  Umbilical cord
  sig_peptide 191..247: Von Heijne matrix
  score 3.80
  unsure -8: seq LSLCIXXLEHLFT/WP
  position -8 of amino acid sequence
  unsure -7: Xaa = Leu,Trp; position -7 of amino acid sequence; Xaa = Ser,Thr
acactgaatcttctagagccacggtagccaaccttttaaaatcagttgagggcacttaaaaaaatacatcagtatttttacacctgatttttacacctgggccccagccttgtgcaacagaacctaggggtggagtctaagcatggacagtttttaaagccccaggcagccagggctgaggaccttggcgatggagcctgtwagttcgctttccttgtgtatatkgwctcttgagcatctcttcacatggcccaaaggg

SEQ ID NO: 602 - DNA, 203 bp, Homo Sapiens
  Lymph ganglia
  sig_peptide 120..176: Von Heijne matrix; score 3.80; seq WCSAAAWRSPLSA/AT
actcgccggcgccaggcagtgggaagtcaggttcttccgccacctcccagccaggactctgccaccctccctcaggatgcctgagggccccgagctgcacctggccagccagtktgtgaatgaggcctgcagggcgctggtgttcggcggctgcgtggagaagtcctctgtcagccgcaaccctgaagtgccctttgagaggg

SEQ ID NO: 603 - DNA, 66 bp, Homo Sapiens
  Lymph ganglia
  sig_peptide 10..57: Von Heijne matrix; score 3.70; seq CAYVLFFFNGCLY/RR
acttgggaaatgtggttgtgtgcgtatgtattatttttttttaatggatgtttatataggagaaag

SEQ ID NO: 604 - DNA, 289 bp, Homo Sapiens
  Lymph ganglia
  sig_peptide 152..196: Von Heijne matrix
  score 3.60
  unsure 31: seq LLHRAVVLRLQQA/CR; position 31 of amino acid sequence; Xaa = Ala,Asp,Glu,Gly
aaaaaattgcagtgctgaagacactggacccgcaaaaggctgtccctcccaaacctgggattctgggctcactgagttcacctgcgagtcagccctacctgcactgctctggtctagtacaaacaggctgctggcattgaggtctgctacaatgctgctgctgcacagagctgtggtcctcaggctccaacaggcctgcagaccgacctctcttccagactcaagtcaatcccctcaaggatctgcattcaggcctgctccacaaatgattcatttcagcccccttgvs

SEQ ID NO: 605 - DNA, 268 bp, Homo Sapiens
  Umbilical cord
  sig_peptide 110..205: Von Heijne matrix
  score 3.60
  unsure -27: seq SLVPSMCFHVTNS/IK
  position -27 of amino acid sequence
  unsure -26: Xaa =  * ,Leu
  position -26 of amino acid sequence
  unsure -14: Xaa = Ile,Val; position -14 of amino acid sequence; Xaa =  * ,Trp
acgccaaatgattatactcgggacacctgacccagtttcttcaacaaatatatggagggaaacgtgtgtvtaggacgggggtrttttaaataaaaagggctttaagacgatggaaatgtttggttwrrttgaaaaagatttttcatcagtggaaggggttctatrgagcctggtaccttcaatgtgtttccatgttaccaactccataaagatgccctggtttcccagccaaccaggtacttgcacccagaaggattgccctccgaag

SEQ ID NO: 606 - DNA, 148 bp, Homo Sapiens
  Lymph ganglia
  sig_peptide 5..142: Von Heijne matrix; score 3.60; seq LLGVHASFQMSVA/AR
aattatgcagatgcacggctggaggtgggatccacacagctcagaacagctggatcttgctcacactctttcaagagaagcttccttggagaataacacagcccttctgggagtccacgccagcttccaaatgtctgtggcagcacgg

SEQ ID NO: 607 - DNA, 199 bp, Homo Sapiens
  Lymphocytes
  sig_peptide 89..190: Von Heijne matrix; score 3.60; seq VGTGVLTSRLARA/TP
tcgaacttggagatagctggttctcctcgaaatagctttagggctagcgtgtagtgttaagtagtggtggtagagcactgaatatggaatggcctcgcctaggggtactgactataatcaaactccgaataccactatgtattgctatgcagtcggaaccggggtgctaacgtcccggctcgcgagggcaacacccggg

SEQ ID NO: 608 - DNA, 356 bp, Homo Sapiens
  Lymphocytes
  sig_peptide 144..269: Von Heijne matrix; score 3.60; seq LHCLCPFPALFLS/VT
aaaaactgctatgcttccgttactactccagmtatactggcctcttgctttcscytcagcattactaatatattcctcccttagagcctttgcactggtttttccctctgcttaaagcattcccctccccaccccacatttacatggctcccatcctcagctccttcaagtctttgctcaaatatcatcttcttgagacttctctaagcattctattgaaacctgtaaccttgcactgcctctgcccctttcctgctttatttctatctgttacatttatctatctgacatattatatatttaacttatatattttgtttattgtctgtctcctctactggaatgtactttccatg

SEQ ID NO: 609 - DNA, 155 bp, Homo Sapiens
  Lymph ganglia
  sig_peptide 63..128: Von Heijne matrix; score 3.50; seq ILVPWWLPPFVYT/AI
agaaaaaaaacttcaaaattgaggatctctgtaatttaaatcctacttaacaaagtaaatgcatgaacaggttgtctaaacatcttattatacttgttccttggtggcttcctccctttgtttacactgccatatcctatgtccaactcccaggg

SEQ ID NO: 610 - DNA, 217 bp, Homo Sapiens
  Lymph ganglia
  sig_peptide 122..208: Von Heijne matrix; score 3.50; seq ALITILILYSSNS/AI
acctctgcactcctgcccgccctgcccccggcctgtctgctggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccattggg

SEQ ID NO: 611 - DNA, 367 bp, Homo Sapiens
  Lymphocytes
  sig_peptide 149..352: Von Heijne matrix; score 3.50; seq CLFLSPQSFLVLS/WA
ataacatttggtgccgaaagcccgggataggggaactcctccggcagacctctcctctatcctcccggtacccacgttctcccatgcaagagacttccctcgccctcaggacctcagaccagctccgcgagcactccggcctctgtctatggatatgaaatccaacaccggtcacggactcttcttggggagacagccttccttcagtgttcggtcaatgcccgggacgcccgccttggccatttgccagccacacaacccaggacctccaatggggacgcccactgaggatcctagtggttgctcttttccttgtctctttctttccccccagtctttccttgttctatcatgggcaatttcccgc

SEQ ID NO: 612 - DNA, 300 bp, Homo Sapiens
  Lymph ganglia
  sig_peptide 193..279: Von Heijne matrix; score 3.50; seq LSLSSTLLLTSHH/HQ
acaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcggg

SEQ ID NO: 613 - DNA, 422 bp, Homo Sapiens
  Lymph ganglia
  sig_peptide 81..137: Von Heijne matrix
  score 12.80
  misc_feature 255..284: seq XVFLVALLRGVQC/QV; blastn; identity 96; region 201..230
  id R72787
  misc_feature 121..152: est; blastn; identity 90; region 1..32
  id H73816
  misc_feature 241..283: est; blastn; identity 93; region 161..203
  id SSC1D10
  unsure -15: est
  position -15 of amino acid sequence
  unsure -13: Xaa = Lys,Leu,Met,Gln; position -13 of amino acid sequence; Xaa =  * ,Trp
aagchctgggagaggagcccagcactagaagtcggcggwgtttccattcggtgatcagcactgaacacagaggactcaccatggagtccgggmwggggtgrgttttcctcgttgctcttttaagaggtgtccagtgtcaggtgcagattgtgcagtctgggggaggcgtggtccagcctgggaagtcccagacactctcctgtgttacctatggattcagattcgatgactttggcttccactgggtccgccaggctccaggcaaggggctggaatgggtggcaatgatacgttatgatggaagtaataaattctactcaaagtctgttcagggccgatttctcatctccagagacaattccagaaaccaagtctatttgagtctgaacagactgagagtcgacgacacggctgtctattat

SEQ ID NO: 614 - DNA, 366 bp, Homo Sapiens
  Umbilical cord
  sig_peptide 289..339: Von Heijne matrix
  score 9.30
  misc_feature 134..363: seq LFTLLLLQSLLLG/CC; blastn; identity 98; region 1..230
  id AA009645
  unsure 5: est; position 5 of amino acid sequence; Xaa = Ile,Met
caaatgatgtattcagtgaataaaagaatcccttttataaaatctatttttctttaaatcttggaaaaatgttgttttagctcagagtgatttcaaagtggaatgcaacagtagtcaagacttgtgtactataaatccttttctgattccttacagatttgtagtgatgaggtttagatttaattttatatatggtktaaataattgttaagcktatataacctgatctgaattgcagttgtttgcatktcctctatgaaaacttcatttatctaataaggaagtcaaatgctttgtagactatttaccttacttttgttgcaatcactgttgttgggttgctgtatatatatrccgggcaatggg

SEQ ID NO: 615 - DNA, 308 bp, Homo Sapiens
  Lymph ganglia
  sig_peptide 18..95: Von Heijne matrix
  score 9.30
  misc_feature 43..97: seq FLLLVAGPRWVLS/QV; blastn; identity 90; region 1..55; id H30111; est
agtgctttctgagagtcatggacctcctgcacaagaacatgaaacacctgtggttcttcctcctcctggtggcaggtcccagatgggtcctgtcccaagtgcggctggaacagtggggctctggactagtgaagtcttccgaaacgctgtccctcacctgcgctgtctatggtggatccgccatcagtgactactgggcttggatccgtcaattcccaggaaagggagtggagtggatcggtgaaatcaatcacagtggcgccacccactatatccgtccctcaggggtcgagtcgccatctccgctg

SEQ ID NO: 616 - DNA, 355 bp, Homo Sapiens
  Lymph ganglia
  sig_peptide 125..277: Von Heijne matrix
  score 8.10
  misc_feature 41..237: seq VCLCGTFCFPCLG/CQ; blastn; identity 98; region 1..197
  id R68856
  misc_feature 236..354: est; blastn; identity 97; region 197..315
  id R68856
  misc_feature 44..354: est; blastn; identity 98; region 1..311
  id T87538
  misc_feature 43..331: est; blastn; identity 98; region 2..290
  id W95563
  misc_feature 62..237: est; blastn; identity 99; region 1..176
  id H67429
  misc_feature 236..354: est; blastn; identity 97; region 176..294
  id H67429
  misc_feature 65..354: est; blastn; identity 98; region 1..290
  id AA046628
  unsure 23: est
  position 23 of amino acid sequence
  unsure 25: Xaa =  * ,Tyr; position 25 of amino acid sequence; Xaa = Ile,Asn,Thr
aaagttacctctcccctttcacgtarttttcatttgtggtgagattctctcccargccacaagacatttcctgctcggaaccttgtttactaatttccactgcttttaaggccctgcactgaaaatgcaagctcargcgccggtggtcgttgtgacccaacctggagtcggtcccggtccggccccccagaactccaactggcagacaggcatgtgtgactgtttcagcgactgcggagtctgtctctgtggcacattttgtttcccgtgccttgggtgtcaagttgcagctgatatgaatgaatgctgtctgtgtggaacaagcgtcgcaatgaggactctctamaggahccgg

SEQ ID NO: 617 - DNA, 229 bp, Homo Sapiens
  Lymphocytes
  sig_peptide 74..127: Von Heijne matrix
  score 7.70
  misc_feature 177..229: seq LLLLPVLGLLVSS/KT; blastn; identity 90; region 1..53; id N41594; est
aaagaaagagctgcsgtgcaggaattcgtgtgccggatttggttagctgagcccaccgagaggcgcctgcaggatgaaagctctctgtctcctcctcctccctgtcctggggctgttggtgtctagcaagaccctgtgctccatggaagaagccatcaatgagaggatccaggaggtcgccggctccctaatatttagggcaataagcagcattggccgagggagcgag

SEQ ID NO: 618 - DNA, 265 bp, Homo Sapiens
  Lymph ganglia
  sig_peptide 89..151: Von Heijne matrix
  score 6.60
  misc_feature 87..259: seq LLXIVGLXLPTXG/QX; blastn; identity 94; region 82..254
  id AA075901
  misc_feature 66..259: est; blastn; identity 94; region 1..194
  id R55519
  misc_feature 66..259: est; blastn; identity 94; region 2..195
  id H25630
  misc_feature 67..259: est; blastn; identity 94; region 3..195
  id H43485
  misc_feature 78..259: est; blastn; identity 94; region 1..182
  id H80718
  est
  misc_feature 24: n=a, g, c or t
  unsure -11: position -11 of amino acid sequence
  unsure -6: Xaa = Ile,Thr
  position -6 of amino acid sequence
  unsure -2: Xaa = Ile,Lys,Met,Asn
  position -2 of amino acid sequence
  unsure 2,7: Xaa = Ile,Arg,Ser; position 2, 7 of amino acid sequence; Xaa = Ala,Thr
acctggcysbmcmctccgcctggncgcagcakccaccgchgcgtccctctctccacgaggctgccggcttaggacccccakctccgacatgtcgccctctggtcgcctgtgtcttctmaycatcgttggcctrawkctccccaccakwggacagrcgttgaaagataccrcgtccagttcttcagcagactcaactatcatggacattcaggtcccgacacgagccccagatgcagtctacacagaactccagcccacccacggg

SEQ ID NO: 619 - DNA, 314 bp, Homo Sapiens
  Lymph ganglia
  sig_peptide 147..209: Von Heijne matrix
  score 6.20
  misc_feature 79..240: seq FLVSNMLLAEAYG/SG; blastn; identity 96; region 28..189
  id AA122029
  misc_feature 82..267: est; blastn; identity 95; region 26..211
  id HUML1833
  misc_feature 148..275: est; blastn; identity 99; region 1..128; id AA158721; est
aagttctaaagagaggctgkwtaccakaacagcataacaagggcaggtctgactgcaaggctgtggactgggaggcagagccgccgccaagggggcctcggttaarcactggtcgttcaatcacctgcaagacgaaggaggcaaggatgctgttggcctgggtacaagcattcctcgtcagcaacatgctcctagcagaagcctatggatctggaggctgtttctgggacaacggccacctgtaccgggaggaccagacctcccccgcgccgggcctccgctgcctcaactggctggacgcgcagaacgggctg

SEQ ID NO: 620 - DNA, 421 bp, Homo Sapiens
  Lymph ganglia
  sig_peptide 26..211: Von Heijne matrix
  score 5.80
  misc_feature 67..123: seq LXLTCSVSGGSIS/RT; blastn; identity 98; region 1..57
  id H30111
  misc_feature 41..137: est; blastn; identity 90; region 1..97
  id T27715
  misc_feature 43..137: est; blastn; identity 91; region 2..96
  id T27727
  misc_feature 136..213: est; blastn; identity 92; region 93..170
  id T27727
  misc_feature 98..137: est; blastn; identity 90; region 1..40
  id H43753
  misc_feature 44..137: est; blastn; identity 92; region 4..97
  id T28164
  est
  misc_feature 7..8,319..323: n=a, g, c or t
  unsure -28: position -28 of amino acid sequence
  unsure -20: Xaa = Ala,Asp
  position -20 of amino acid sequence
  unsure -12: Xaa = Leu,Met,Val
  position -12 of amino acid sequence
  unsure 26: Xaa = Cys,Ser
  position 26 of amino acid sequence
  unsure 36: Xaa = Lys,Arg
  position 36 of amino acid sequence
  unsure 37: Xaa = Arg,Ser
  position 37 of amino acid sequence
  unsure 38: Xaa = any one of the twenty amino acids; position -38 of amino acid sequence; Xaa =  * ,Glu,Gly,Lys,Gln,Arg,Trp
aattcanntccaactcataagggaaatgctttctgagagtcgtggacctcctgtgcaagaacatgaagcacctgtggttcttcctcctgctggtggcggctcccagatgggtcctgtcccagctgcagmtgcaggggagtcgggcccaggavtggtgaagcctttggagaccctgtscctcacctgcagtgtctcaggtggctcgatcagtaggaccagtttctactggggctggatccgccagcccccagggaagggactggagtggattgggagtatctatgatarggggagcacctactacaacccgtccctcagnnnnnrrgtcaccatttcagtagacacgtccaagaaccaggtgtccctgaaggtgagctctgtgaccgccgcggacacggccgtatatcactgtgcgagaggg

SEQ ID NO: 621 - DNA, 431 bp, Homo Sapiens
  Lymph ganglia
  sig_peptide 21..344: Von Heijne matrix
  score 5.30
  misc_feature 220..343: seq ACMTLTASPGVFP/SL; blastn; identity 98; region 1..124
  id N57208
  misc_feature 329..431: est; blastn; identity 93; region 111..213
  id N57208
  misc_feature 329..431: est; blastn; identity 94; region 55..157
  id R94133
  misc_feature 276..343: est; blastn; identity 100; region 1..68
  id R94133
  misc_feature 344..431: est; blastn; identity 93; region 1..88
  id AA110914
  unsure -99: est; position -99 of amino acid sequence; Xaa = Phe,Ile,Ser,Thr
aaacaactccggaaagtacaatgaccagcgggcaggcccgagcttccwyccagtccccccaggccctggaggactcgggcccggtgaatatctcagtctcaatcaccctaaccctggacccactgaaacccttcggagggtattcccgcaacgtcacccatctgtactcaaccatcttagggcatcagattggactttcaggcagggaagcccacgaggagataaacatcaccttcaccctgcctacagcgtggagctcagatgactgcgccctccacggtcactgtgagcaggtggtattcacagcctgcatgaccctcacggccagccctggggtgttcccgtcactgtacagccaccgcactgtgttcctgacacgtacagcaacgccacgctctggtacaagatcttcacaactgccagagatgcca

SEQ ID NO: 622 - DNA, 144 bp, Homo Sapiens
  Lymph ganglia
  sig_peptide 1..63: Von Heijne matrix
  score 5.10
  misc_feature 111..142: seq LLLKIWLLQRPES/QE; blastn; identity 96; region 2..33; id R30650; est
atgctgggaggtgaccatagggctctgcttttaaagatatggctgcttcaaaggccagagtcacaggaaggacttcttccagggagattagtggtgatggagaggagagttaaaaatgacctcatgtccttcttgtccacggcg

SEQ ID NO: 623 - DNA, 301 bp, Homo Sapiens
  Lymph ganglia
  sig_peptide 134..220: Von Heijne matrix
  score 4.60
  misc_feature 248..300: seq SLMSLLDESSCQA/VG; blastn; identity 100; region 1..53; id HSC1XE021; est
aagcgtccctttgttgtgaaggcgccggggcctagcgctatgcctgcggcggagactgcatcaggctctcgtcctcgggctccacccagggagctgtgcccagacagcagaagggaaggatgtcacttctgagatgaggttcagaaaggcctgggctcctgtcctggctgctctctcccactccctgatgagcttgctggatgaaagctcctgtcaggctgtggggcgtcctgtggagaaactggcaagaaactggtgggggccctttccacctatagccagcaaggaactgaacccagcg

SEQ ID NO: 624 - DNA, 377 bp, Homo Sapiens
  Lymph ganglia
  sig_peptide 63..308: Von Heijne matrix
  score 4.40
  misc_feature 85..377: seq NLPHLQVVGLTWG/HI; blastn; identity 100; region 1..293
  id AA148067
  misc_feature 133..327: est; blastn; identity 98; region 58..252
  id AA129289
  misc_feature 75..136: est; blastn; identity 100; region 1..62
  id AA129289
  misc_feature 171..242: est; blastn; identity 98; region 263..334
  id R56463
  misc_feature 239..284: est; blastn; identity 100; region 332..377
  id R56463
  misc_feature 145..180: est; blastn; identity 91; region 236..271; id R56463; est
aacttccggtcgcgccascgcccgttgccagttctgcgcgtgtcctgcatctccagtatggaatgtatgtdtggccctgtgctgtggtcctggcccagtacctttggtttcacagaagatctctgccaggcaaggccatcttagagattggagctggagtgagccttccaggaattttggctgccaaatgtggtgcagaagtaatactgtcagacagctcagaactgcctcactgtctggaagtctgtcggcaaagctgccaaatgaataacctgccacatctgcaggtggtaggactaacatggggtcatatatcttgggatcttctggctctaccaccacaagatattatccttgcatctgatgtgttctttgaa

SEQ ID NO: 625 - DNA, 380 bp, Homo Sapiens
  Umbilical cord
  sig_peptide 3..170: Von Heijne matrix
  score 4.40
  misc_feature 308..380: seq LWKLALQSSSCLS/LF; blastn; identity 98; region 29..101
  id W52747
  misc_feature 265..294: est; blastn; identity 93; region 1..30
  id W52747
  unsure -50: est
  position -50 of amino acid sequence
  unsure -19: Xaa = Cys,Ser
  position -19 of amino acid sequence
  unsure 35: Xaa = Asp,Glu,Gly
  position 35 of amino acid sequence
  unsure 51: Xaa = Glu,Gly; position 51 of amino acid sequence; Xaa = Cys,Ser,Tyr
aaatgcttaatccagcacagtscgacactatgccttgtgaatacctctctttggatgcaatggaaaagtggattatctttggctttattttgtgccatgggatcctaaatactgrsgctacagcactgaacctttggaaactagctcttcaaagtagctcttgcctctctctctttcgggatgaagttttccacattcacaaagctgcagaagacttatttgtaaacatacgaggctataataaacgtattaatgacataagagaatgcaaggrggcagccgtgtcacatgctggttcaatgcacagagaaagacgcaagtvtttaagatctgcactgaaggaattggctactgtcctctctgatcaacctggattgcta

SEQ ID NO: 626 - DNA, 214 bp, Homo Sapiens
  Lymph ganglia
  sig_peptide 134..205: Von Heijne matrix
  score 3.90
  misc_feature 104..213: seq GVCLSVPSLPSIS/RP; blastn; identity 98; region 2..111; id T11539; est
acacagtgatgtagagctttggctctttgtaaccaggagttcgataggaagacaactttgaaaaagcactttgtgactggcagggtgccatgcagcctcagctgttcatttccaagggtcatccatttacaggatgaatgctcaagcctcttcctcccggtgccatggagtctgcctgtcagtcccctccttgcccagcatctcccgcccgccg

SEQ ID NO: 627 - DNA, 485 bp, Homo Sapiens
  Umbilical cord
  sig_peptide 264..464: Von Heijne matrix
  score 3.80
  misc_feature 263..411: seq QVLDSVLVGPVPA/ER; blastn; identity 100; region 155..303
  id AA005338
  misc_feature 110..208: est; blastn; identity 95; region 1..99
  id AA005338
  misc_feature 409..469: est; blastn; identity 95; region 302..362
  id AA005338
  misc_feature 206..250: est; blastn; identity 100; region 98..142
  id AA005338
  misc_feature 299..446: est; blastn; identity 99; region 192..339
  id AA005431
  misc_feature 110..208: est; blastn; identity 97; region 1..99
  id AA005431
  misc_feature 206..250: est; blastn; identity 100; region 98..142
  id AA005431
  misc_feature 263..300: est; blastn; identity 100; region 155..192
  id AA005431
  misc_feature 263..433: est; blastn; identity 98; region 175..345
  id W78855
  misc_feature 89..250: est; blastn; identity 99; region 1..162
  id W78855
  misc_feature 89..250: est; blastn; identity 98; region 2..163
  id H52413
  misc_feature 263..400: est; blastn; identity 91; region 176..313
  id H52413
  misc_feature 263..389: est; blastn; identity 96; region 5..131
  id AA057872
  misc_feature 375..470: est; blastn; identity 95; region 118..213; id AA057872; est
atgaactcgggtgcagccaatcgagggcaacgctgctacttatcagagcagaatgggctgtagtttagtgaaataggaaagctgcaacacactgtggagtgctcccgtgtaaataataagaggaaaaaagtttctcaagtcgccgctgcacgacgtctggccggcgctggagcgggggtctgcgctctcccgagcggccgcgcgctggactttattgtgccgcaaccagccccagttcccattgtttgtgtttttttcaaaatatggcaaaggttcaggtgaacaatgtagtggtgctggataacccttctcctttctacaacccgttccagttcgagatcaccttcgagtgcatcgaggacctgtctgaagacttggaatggaaaattatctatgtgggctctgcagaaagtgaagaatacgatcaagttttagactctgttttagtgggtcctgttcccgcagaaaggcatatgtttgtattt

SEQ ID NO: 628 - DNA, 169 bp, Homo Sapiens
  Lymphocytes
  sig_peptide 56..118: Von Heijne matrix
  score 3.70
  misc_feature 58..160: seq ETCALASHSGSSG/SK; blastn; identity 100; region 48..150
  id AA037680
  misc_feature 58..122: est; blastn; identity 95; region 31..95
  id W81645
  misc_feature 121..170: est; blastn; identity 98; region 93..142
  id W81645
  misc_feature 65..122: est; blastn; identity 94; region 7..64
  id W06951
  misc_feature 121..170: est; blastn; identity 98; region 62..111
  id W06951
  misc_feature 59..168: est; blastn; identity 90; region 1..110; id AA034702; est
aagccttccgccktccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtg

SEQ ID NO: 629 - DNA, 141 bp, Homo Sapiens
  Lymph ganglia
  sig_peptide 76..117: Von Heijne matrix
  score 3.50
  misc_feature 70..114: seq WTCLLGDCGPPEA/FT; blastn; identity 95; region 231..275
  id AA130776
  misc_feature 88..139: est; blastn; identity 98; region 1..52
  id AA121716
  misc_feature 70..112: est; blastn; identity 95; region 167..209; id AA146672; est
acwmttccctctgttggagctcagaacatgacactccaaaacatggcaccttggtaattacgaaaacagcagaaaatgtggacatgcttactcggggattgtggcccaccagaagcatttacttcctaccaaccccccagg

SEQ ID NO: 630 - DNA, 247 bp, Homo Sapiens
  Lymph ganglia
  sig_peptide 38..94: Von Heijne matrix
  score 11.70
  misc_feature 2..56: seq VFCLLAVAPGAHS/QV; blastn; identity 90; region 10..64
  id R86288
  unsure -14,13: est
  position -14, 13 of amino acid sequence
  unsure 8,44: Xaa = Arg,Thr
  position 8, 44 of amino acid sequence
  unsure 10: Xaa = Gly,Arg
  position 10 of amino acid sequence
  unsure 39: Xaa = Glu,Gln; position 39 of amino acid sequence; Xaa = His,Gln
atctctacagaaccctctgagaggaaagttcttcaccatggactggacctggasggtcttctgcttgctsgctgtagctccaggtgctcactcccaggtgcaactggtgcagtctsgggctsaggtgaggasgcctggggcctcagtgaaggtttcgtgcaaaccatctggatacagtttcaccagccactatgtscattgggtgcggcasgaccccggacaasggcttgagtggatgggagatggg

SEQ ID NO: 631 - DNA, 307 bp, Homo Sapiens
  Umbilical cord
  sig_peptide 83..181: Von Heijne matrix
  score 10.90
  misc_feature 117..250: seq LVSLLLLLTRVQP/GT; blastn; identity 97; region 17..150
  id R28399
  misc_feature 240..278: est; blastn; identity 92; region 141..179
  id R28399
  misc_feature complement(179..305): est; blastn; identity 99; region 59..185
  id R07794
  misc_feature complement(149..184): est; blastn; identity 94; region 181..216
  id R07794
  misc_feature 187..305: est; blastn; identity 97; region 19..137
  id H84735
  misc_feature 195..234: est; blastn; identity 95; region 250..289
  id R85011
  misc_feature 240..278: est; blastn; identity 94; region 297..335
  id R85011
  misc_feature 195..250: est; blastn; identity 94; region 246..301; id H52765; est
aaacagcttcccctagcacagcacagactacagacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccgg

SEQ ID NO: 632 - DNA, 291 bp, Homo Sapiens
  Lymph ganglia
  sig_peptide 7..63: Von Heijne matrix
  score 10.90
  misc_feature 13..66: seq FLLLVAAPRWVLS/QV; blastn; identity 94; region 3..56
  id H30111
  est
  misc_feature 268: n=a, g, c or t
  unsure -18: position -18 of amino acid sequence
  unsure -15: Xaa = Lys,Arg
  position -15 of amino acid sequence
  unsure 16: Xaa = Ser,Trp
  position 16 of amino acid sequence
  unsure 22: Xaa = Glu,Gln
  position 22 of amino acid sequence
  unsure 40: Xaa =  * ,Cys
  position 40 of amino acid sequence
  unsure 49: Xaa = Arg,Ser
  position 49 of amino acid sequence
  unsure 61: Xaa = Arg,Trp
  position 61 of amino acid sequence
  unsure 62: Xaa =  * ,Ala,Glu,Ile,Lys,Leu,Ser,Thr,Val
  position 62 of amino acid sequence
  unsure 67: Xaa = Glu,Lys
  position 67 of amino acid sequence
  unsure 69: Xaa = Asp,Glu
  position 69 of amino acid sequence
  unsure 73: Xaa = Ala,Pro,Ser,Thr; position 73 of amino acid sequence; Xaa = Ala,Val
aagaacatgaracacctgtsgttcttcctcctgctggtggcagctcccagatgggtcctgtcccaggtgctactacaggagtcgggccctgaactggtgaagccttcasagaccctgtccctcacctgmgctgtctctggtggctccatcagcggtggtccttactattggaactgggtcmgccagcacccagggaagggcctggarwggattggcaacatctattacaatgggagcaccttcdharaacccgtccctcaagastcgncttatcatatcgyyagacgcagg

SEQ ID NO: 633 - DNA, 326 bp, Homo Sapiens
  Lymph ganglia
  sig_peptide 72..155: Von Heijne matrix
  score 9.60
  misc_feature 205..321: seq LLTLLLGLTEVAG/EE; blastn; identity 94; region 107..223
  id W05822
  misc_feature 100..210: est; blastn; identity 94; region 1..111
  id W05822
  misc_feature complement(218..248): est; blastn; identity 90; region 105..135
  id AA135917
  est
  misc_feature 325: n=a, g, c or t
  unsure 57: position 57 of amino acid sequence; Xaa = His,Ile,Lys,Leu,Met,Asn,Pro,Gln,Arg,Ser,Thr
agtcttcbsgcagggcctgacatctccccagaacagacgtttgaacagagcaggcttctgaggtctccaaaatgcctgtcccagcctcctggccccatcctcctggtcctttcctgcttctgactctactgctrggacttacagaagtggcaggtgaggargagctacagatgattcagcctgagaagctcctgttggtcacagttggaaagacagccactctgcactgcactgtgacctccctgcttcccgtgggacccgtcctgtggttcagaggagttggaccaggccgggaattaatctacaatcaaaaagaaggcctamnb

SEQ ID NO: 634 - DNA, 330 bp, Homo Sapiens
  Umbilical cord
  sig_peptide 217..261: Von Heijne matrix
  score 9.60
  misc_feature 70..216: seq EYVLLLFLALCSA/KP; blastn; identity 100; region 68..214
  id W01897
  misc_feature 4..56: est; blastn; identity 100; region 1..53
  id W01897
  misc_feature 237..273: est; blastn; identity 97; region 238..274
  id W01897
  misc_feature 177..331: est; blastn; identity 99; region 1..155; id H87389; est
aagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagag

SEQ ID NO: 635 - DNA, 143 bp, Homo Sapiens
  Lymph ganglia
  sig_peptide 27..77: Von Heijne matrix
  score 9.30
  misc_feature 22..143: seq LALSLLILVLAFG/IP; blastn; identity 95; region 1..122
  id AA027314
  misc_feature 51..143: est; blastn; identity 95; region 29..121
  id AA149456
  misc_feature 69..143: est; blastn; identity 92; region 36..110
  id W17274
  misc_feature 33..75: est; blastn; identity 100; region 1..43; id W17274; est
actcttactcaccctctaccacagacatggctcagtcactggctctgagcctccttatcctggttctggcctttggcatccccaggacccaaggcagtgatggaggggctcaggactgttgcctcaagtacagccaaacgagg

SEQ ID NO: 636 - DNA, 305 bp, Homo Sapiens
  Lymph ganglia
  sig_peptide 57..107: Von Heijne matrix
  score 8.20
  misc_feature complement(228..303): seq LLLITAILAVAVG/FP; blastn; identity 97; region 206..281
  id N70479
  misc_feature complement(77..112): est; blastn; identity 97; region 403..438
  id N70479
  misc_feature complement(163..196): est; blastn; identity 100; region 315..348
  id N70479
  unsure 7: est; position 7 of amino acid sequence; Xaa = His,Gln
aacttgccatttctcataacagcgtcagagagaaagaactgactgaaacgtttgagatgaagaaagttctcctcctgatcacagccatcttggcagtggctgttggtttcccagtctctcaagaccakgaacgagaaaaaagaagtatcagtgacagcgatgaattagcttcagggttttttgtgttcccttacccatatccatttcgcccacttccaccaattccatttccaagatttccatggtttagacgtaattttcctattccaatacctgaatctgcccctacaactccccttccgatg

SEQ ID NO: 637 - DNA, 323 bp, Homo Sapiens
  Lymph ganglia
  sig_peptide 90..140: Von Heijne matrix
  score 8.20
  misc_feature complement(261..320): seq LLLITAILAVAVG/FP; blastn; identity 95; region 222..281
  id N70479
  misc_feature complement(110..145): est; blastn; identity 94; region 403..438
  id N70479
  misc_feature complement(196..229): est; blastn; identity 94; region 315..348
  id N70479
  unsure 24: est
  position 24 of amino acid sequence
  unsure 50: Xaa = Phe,Ile; position 50 of amino acid sequence; Xaa = Lys,Asn
aatatraracagctacaatattccagggccartcacttgccatttctcataacagcgtcagagagaaagaactgactgaracgtttgagatgaagaaagttctcctcctgatcacagccatcttggcagtggctgtwggtttcccagtctctcaagaccaggaacgagaaaaaagaagtatcagtgacagcgatgaattagcttcaggrwtttttgtgttcccttacccatatccatttcgcccacttccaccaattccatttccaagatttccatggtttagacgtaawtttcckattccaatacctgaatctgcccctggg

SEQ ID NO: 638 - DNA, 302 bp, Homo Sapiens
  Placenta
  sig_peptide 150..203: Von Heijne matrix
  score 8.10
  misc_feature 130..267: seq LFTAILAFSLAQS/FG; blastn; identity 96; region 104..241
  id T58582
  misc_feature 28..129: est; blastn; identity 99; region 1..102
  id T58582
  misc_feature 18..270: est; blastn; identity 99; region 1..253
  id C18397
  misc_feature 97..300: est; blastn; identity 99; region 2..205
  id R62763
  misc_feature 97..300: est; blastn; identity 99; region 1..204; id R63635; est
aagccttcctagatcccctccactcggtttctctctttgcaggagcaccggcagcaccagtgtgtgaggggagcaggcagcggtcctagccagttccttgatcctgccagaccacccagcccccggcacagagctgctccacaggcaccatgaggatcatgctgctattcacagccatcctggccttcagcctagctcagagctttggggctgtctgtaaggagccacaggaggaggtggttcctggcgggggccgcagcaagagggatccagatctctaccagctgctccagagaccctgg

SEQ ID NO: 639 - DNA, 416 bp, Homo Sapiens
  Lymph ganglia
  sig_peptide 42..92: Von Heijne matrix
  score 7.90
  misc_feature 17..102: seq VLLLGLLSHCTVS/VS; blastn; identity 90; region 1..86
  id H16140
  misc_feature 15..47: est; blastn; identity 93; region 16..48
  id H26913
  est
  misc_feature 360: n=a, g, c or t
  unsure 88: position 88 of amino acid sequence
  unsure 90: Xaa = Asn,Tyr; position 90 of amino acid sequence; Xaa =  * ,Glu,Lys,Gln
aagtctgggcctawggaagcagcactggtggtgcctcagccatggcctggaccgttctcctcctcggcctcctctctcactgcacagtgtctgtgagctcctacgaactgactcagccaccctcagtgtcagtggccccaggagagacggccaccatttcctgtggggcaaacaatgttggaagaaaaaatgtgcagtggtatcagcagaaggcaggccaggcccctgtgttggtcatttaccatgatgtcgagcggccctcggggattcctgagcgattctctggctccaactctgggagtccggccaaactgaccatcagcagggtcgaagccggggatgaggccgactatwactgtnaggtgtgggacagtgacagtgatcatacggtgatattcggcggcgggaccaagctg

SEQ ID NO: 640 - DNA, 519 bp, Homo Sapiens
  Lymph ganglia
  sig_peptide 274..447: Von Heijne matrix
  score 7.70
  misc_feature 166..454: seq PXLLLQTLPASTX/XP; blastn; identity 91; region 87..375
  id N23576
  misc_feature 79..150: est; blastn; identity 97; region 1..72
  id N23576
  misc_feature 445..520: est; blastn; identity 92; region 367..442
  id N23576
  misc_feature complement(56..115): est; blastn; identity 98; region 362..421
  id W15210
  misc_feature complement(2..58): est; blastn; identity 96; region 418..474
  id W15210
  misc_feature complement(2..118): est; blastn; identity 100; region 18..134
  id R07597
  est
  misc_feature 159,162..165: n=a, g, c or t
  unsure -51: position -51 of amino acid sequence
  unsure -31: Xaa =  * ,Glu
  position -31 of amino acid sequence
  unsure -29: Xaa = Asn,Thr
  position -29 of amino acid sequence
  unsure -25: Xaa = Ala,Gly,Val
  position -25 of amino acid sequence
  unsure -17: Xaa = Gly,Val
  position -17 of amino acid sequence
  unsure -12: Xaa = Ala,Leu,Pro,Ser,Val
  position -12 of amino acid sequence
  unsure -1,8: Xaa = Ala,Thr
  position -1, 8 of amino acid sequence
  unsure 1: Xaa = Pro,Thr; position 1 of amino acid sequence; Xaa = His,Gln
aagtaccttttcagtcttgccccagaggttccctcaatttcagcagcaccgagcggtttataattcattcagttttccaggccaggcagcccgctatccttggatggcctttccacgcaatagcatcatgcacttgaaccacacarcatabgagagggnrgnnnnstaatttsttggacttssvtstbccgccacagcrsaacacaggtctgggagggatccctgtagcaggtattccagcgtcttcaggaaacagtttagactctcttcaagatgacaatcctccacactggskaaaatcccttcaggccctcacagagatggacggccccagcgctgctccatcacagacccamcacagbgcccccttcagkacacagatcccgctgcacagagbyagttggaatccctrcsctcctccttcaracscttccagcttccactmcccasccccaggctttcagacggmcttcagaccccccagcaaaacccccacagatttactacagagttcaacac

SEQ ID NO: 641 - DNA, 384 bp, Homo Sapiens
  Lymph ganglia
  sig_peptide 40..99: Von Heijne matrix
  score 7.20
  misc_feature 21..73: seq LLLLVAAPKXXLS/QV; blastn; identity 92; region 4..56
  id T28164
  unsure -4: est
  position -4 of amino acid sequence
  unsure -3: Xaa = Cys,Phe
  position -3 of amino acid sequence
  unsure 58: Xaa = Phe,Val; position 58 of amino acid sequence; Xaa = Ile,Val
atatactttctgagagtbctggacctcctgtgcaagaacatgaaacacctgtggttcttcctcctgctgctggtggcagctcccaaatkyktcctgtcccaggtgcagctgcgggagtcgggcccaggactggtggagccttcacagaccctgtccctcacctgcagtgtttctcgtggctccgtcaacagcgggggttactactggagttggatccgccagcacccaggaaagggcctggagtggattgggtacgtctattacggtggrrtaacgtactacaacccgtccctcaagagtcgagtcaccctatcagcagacacgtctaagaaccagttcttcctgcggctgacctcaatgactgccgcggacacggccagtggg

SEQ ID NO: 642 - DNA, 248 bp, Homo Sapiens
  Umbilical cord
  sig_peptide 120..182: Von Heijne matrix
  score 6.90
  misc_feature 69..194: seq LVCGSLGLSNVSG/IY; blastn; identity 100; region 1..126
  id R65867
  misc_feature 208..245: est; blastn; identity 97; region 140..177
  id R65867
  misc_feature complement(208..245): est; blastn; identity 97; region 194..231; id R22927; est
aatatttatataaatattabytattagtgagttgttattcatcctttggatgcaaattgtaaattaggaaactattttattactgcttttttgtggttaaacactttattttaatataaatgttgagttattttctatcctctttggtgtgcggtagtttaggtctcagtaatgtttctggtatatatgattccaaaaaaaagcgaaaaacaggtgcttttaggacacaacttttctggggagtcggg

SEQ ID NO: 643 - DNA, 380 bp, Homo Sapiens
  Umbilical cord
  sig_peptide 210..335: Von Heijne matrix
  score 6.40
  misc_feature 184..354: seq ELPALALLHAGHA/EP; blastn; identity 99; region 172..342
  id AA043042
  misc_feature 68..185: est; blastn; identity 99; region 55..172
  id AA043042
  misc_feature 12..52: est; blastn; identity 95; region 1..41
  id AA043042
  misc_feature 68..277: est; blastn; identity 99; region 57..266
  id AA042861
  misc_feature 276..348: est; blastn; identity 98; region 266..338
  id AA042861
  misc_feature 10..52: est; blastn; identity 90; region 1..43
  id AA042861
  misc_feature 50..348: est; blastn; identity 99; region 41..339
  id R76970
  misc_feature 19..52: est; blastn; identity 97; region 11..44
  id R76970
  misc_feature 50..331: est; blastn; identity 99; region 40..321
  id AA042849
  misc_feature 10..52: est; blastn; identity 90; region 1..43
  id AA042849
  misc_feature 92..369: est; blastn; identity 97; region 24..301; id H60916; est
aagagatctgggaacccgggagccgaggtaacgaacagctcggtggcagggcctgactgctgcggaggcctcggcaatattgattttagacaggcagacttctgcgttatgacccggctgctgggctacgtggaccccctggatcccagctttgtggctgccgtcatcaccatcaccttcaatccgctctactggaatgtggttgcacgatgggaacacaagacccgcaagctgagcagggccttcggatccccctacctggcctgctactctctaagcatcaccatcctgctcctgaacttcctgcgctcgcactgcttcacgcaggccatgctgagccagcccaggatggagagcctggacacccccgcggcccaggg

SEQ ID NO: 644 - DNA, 288 bp, Homo Sapiens
  Lymph ganglia
  sig_peptide 61..159: Von Heijne matrix
  score 6.30
  misc_feature 23..251: seq SXXPLXSVQLXHA/QR; blastn; identity 96; region 78..306
  id T87972
  misc_feature 251..283: est; blastn; identity 100; region 307..339
  id T87972
  misc_feature complement(36..283): est; blastn; identity 97; region 89..336
  id AA040027
  misc_feature complement(68..283): est; blastn; identity 95; region 81..296
  id R82948
  misc_feature complement(66..283): est; blastn; identity 94; region 104..321
  id H26425
  misc_feature complement(27..60): est; blastn; identity 97; region 329..362
  id H26425
  misc_feature complement(127..245): est; blastn; identity 92; region 127..245
  id T55847
  misc_feature complement(68..131): est; blastn; identity 96; region 242..305
  id T55847
  misc_feature complement(237..283): est; blastn; identity 100; region 88..134
  id T55847
  unsure -12,-11: est
  position -12, -11 of amino acid sequence
  unsure -8: Xaa = Phe,Leu
  position -8 of amino acid sequence
  unsure -3: Xaa =  * ,Leu; position -3 of amino acid sequence; Xaa = Arg,Trp
ataaatagaaaaaaaaaattttgtttcctaggttgaaggtctaattgatacgtttgacttatgatgaccatttatgcactttcaaatgaatttgctttcaaaataaatgaagagcagctgtccttmttwccwctttwaagtgtycagctgwggcatgctcagaggttcctgctggattccagctggagcggtgtgatacccttctttttcagctgttcgtgccttcctttcttgtatccaccaaagtggagacaaatacatgatctcaaagatacacagtaccgttcg

SEQ ID NO: 645 - DNA, 294 bp, Homo Sapiens
  Lymphocytes
  sig_peptide 217..279: Von Heijne matrix
  score 6.10
  misc_feature 2..210: seq LEMLTAFASHIRA/RD; blastn; identity 99; region 19..227
  id W04921
  misc_feature 211..290: est; blastn; identity 97; region 227..306
  id W04921
  misc_feature complement(23..203): est; blastn; identity 99; region 260..440
  id N70602
  misc_feature complement(203..248): est; blastn; identity 93; region 216..261
  id N70602
  misc_feature complement(251..290): est; blastn; identity 97; region 175..214
  id N70602
  misc_feature 47..177: est; blastn; identity 99; region 1..131
  id W37690
  misc_feature 211..290: est; blastn; identity 96; region 165..244
  id W37690
  misc_feature 175..210: est; blastn; identity 97; region 130..165
  id W37690
  misc_feature 46..184: est; blastn; identity 98; region 1..139
  id W70167
  misc_feature 228..290: est; blastn; identity 96; region 183..245
  id W70167
  misc_feature 183..226: est; blastn; identity 95; region 139..182
  id W70167
  unsure -15: est; position -15 of amino acid sequence; Xaa = Ile,Thr
accttggctcggcttggtctgcggcctgtcaaacaggttcgggttcagttctgtcccttcgagaaaaacgtggaatcgacgaggaccttcctgcagacggtgagcagtgagaaggtccgctccactaatctcaactgctcagtgattgcggacgtgaggyatgacggctccgagccctgcgtggacgtgctgttcggagacgggcatcgcctgattatgcgcggcgctcatctcaycgctctggaaatgctcaccgccttcgcctcccacatccgggccagggaygcggcaagg

SEQ ID NO: 646 - DNA, 288 bp, Homo Sapiens
  Umbilical cord
  sig_peptide 76..231: Von Heijne matrix
  score 6.10
  misc_feature complement(2..285): seq IILLIHTMQVCTT/HP; blastn; identity 99; region 26..309
  id H54590
  misc_feature 107..285: est; blastn; identity 99; region 78..256
  id AA143123
  misc_feature complement(169..285): est; blastn; identity 99; region 320..436
  id AA142922
  misc_feature complement(119..168): est; blastn; identity 90; region 436..485
  id AA142922
  misc_feature 29..91: est; blastn; identity 93; region 2..64
  id N88917
  misc_feature 83..140: est; blastn; identity 93; region 55..112
  id N88917
  misc_feature 218..285: est; blastn; identity 98; region 10..77; id AA013161; est
agtaccgatcctcagaggaagagaagagagtgacagtcatcaaagccccgcattacccagggatcgggcccgtggatgaatccggaatccccacagcaattagaacgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccaaacctacagaccccagg

SEQ ID NO: 647 - DNA, 286 bp, Homo Sapiens
  Umbilical cord
  sig_peptide 188..244: Von Heijne matrix
  score 6.10
  misc_feature complement(117..284): seq IILLIHTMQVCTT/HP; blastn; identity 99; region 40..207
  id H54590
  misc_feature 120..284: est; blastn; identity 100; region 78..242
  id AA143123
  misc_feature complement(182..284): est; blastn; identity 100; region 334..436
  id AA142922
  misc_feature complement(132..181): est; blastn; identity 90; region 436..485
  id AA142922
  misc_feature 231..284: est; blastn; identity 100; region 10..63
  id AA013161
  misc_feature 231..284: est; blastn; identity 100; region 10..63; id AA018245; est
aacttctcatgaatgttatgctgtgtgtggcagagaaagaaagctgttgatgggagagaattacacaatctgtttttccatttgaatgaaacatcatgaacattgcgattttgttaaatgacagtcgaccggcccaaggactggtacaagacgatgtttaagcaaattcacatggtgcacaagccggatgatgacacagacatgtataatactccttatacatacaatgcaggtctgtacaacccaccctacagtgctcagtcacaccctgctgcaaagacccatg

SEQ ID NO: 648 - DNA, 355 bp, Homo Sapiens
  Lymph ganglia
  sig_peptide 110..184: Von Heijne matrix
  score 6.00
  misc_feature 176..321: seq LLGLLVAVATVHL/VI; blastn; identity 97; region 158..303
  id R59094
  misc_feature 101..176: est; blastn; identity 97; region 82..157
  id R59094
  misc_feature 56..104: est; blastn; identity 100; region 38..86
  id R59094
  misc_feature 177..256: est; blastn; identity 100; region 193..272
  id R35689
  misc_feature 101..171: est; blastn; identity 97; region 117..187
  id R35689
  misc_feature 60..104: est; blastn; identity 97; region 77..121
  id R35689
  misc_feature 101..171: est; blastn; identity 97; region 115..185
  id H11787
  misc_feature 39..104: est; blastn; identity 98; region 54..119
  id H11787
  misc_feature 2..31: est; blastn; identity 100; region 17..46
  id H11787
  unsure 43: est; position 43 of amino acid sequence; Xaa = Cys,Phe,Tyr
agcttcgaaggacgccgccgggagctgcggacatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgtdcctcgggccagtggtgatcgcagtgttctccagccccgcagtg

SEQ ID NO: 649 - DNA, 401 bp, Homo Sapiens
  Lymph ganglia
  sig_peptide 30..95: Von Heijne matrix
  score 5.90
  misc_feature 37..336: seq LIYILWQLTGSAA/SG; blastn; identity 98; region 18..317
  id H73135
  misc_feature 336..384: est; blastn; identity 93; region 318..366
  id H73135
  misc_feature 25..85: est; blastn; identity 100; region 1..61
  id AA251602
  est
  misc_feature 332: n=a, g, c or t
  unsure 47: position 47 of amino acid sequence
  unsure 79: Xaa = Ile,Asn,Thr
  position 79 of amino acid sequence
  unsure 94: Xaa = Asp,Glu,Gly; position 94 of amino acid sequence; Xaa = Phe,Ser
atttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcahtatcatagtgacccaaaatcgtaatagggagagagtagacttcccagatggaggctactccctgaagctcagcaaactgaagaagaatgactcagrnatctactatgtggggatatacagctcatcactccagcagccctycacccaggagtacgtgctgcatgtc

SEQ ID NO: 650 - DNA, 241 bp, Homo Sapiens
  Umbilical cord
  sig_peptide 179..232: Von Heijne matrix
  score 5.80
  misc_feature 177..233: seq CFIILGLIICIQC/ST; blastn; identity 91; region 314..370; id T47889; est
aaaagccssacttattttggaaacttgtagccagaaaaattagaatttaatttaagcagtagaaaataataaaaactgaaaaatgttaggcaacactagaatttaacaacaggtgtgctatggttttttaaatataattttctttttccagtttcccatttttattaaaagacaaatcatggtaggaatggtttgctttattatacttggcttaattatttgcatacagtgcagcacgggg

SEQ ID NO: 651 - DNA, 352 bp, Homo Sapiens
  Umbilical cord
  sig_peptide 5..43: Von Heijne matrix
  score 5.70
  misc_feature complement(5..325): seq MXLLHSLSSGVRA/PS; blastn; identity 92; region 10..330
  id W27422
  misc_feature 22..250: est; blastn; identity 93; region 151..379
  id AA153616
  misc_feature 75..158: est; blastn; identity 92; region 228..311
  id R19252
  misc_feature 24..75: est; blastn; identity 100; region 178..229
  id R19252
  misc_feature 226..349: est; blastn; identity 97; region 1..124
  id W03861
  misc_feature 24..123: est; blastn; identity 95; region 139..238
  id AA029575
  unsure -12: est
  position -12 of amino acid sequence
  unsure 83: Xaa = Leu,Pro,Arg
  position 83 of amino acid sequence
  unsure 102: Xaa = Ala,Pro,Thr; position 102 of amino acid sequence; Xaa = Asp,Glu
acaaatgcbtcttctgcacagtctatcctcgggagttcgtgcaccatctcctgccccatcatcagtaccgttagggtcagaaaagcccagcaatgtgtctcaggacaggaaagttccagtccctattgggactgaacgttctgcacgtatcaggcaaactggaacgtcagctccatctgttattgggagcaatttgtctacatcagtaggacatagtggcatctggtcctttgaagggattggtggcaatcaagacaaagtagactggtgtaaccctgggatgggaaatvctatgatccacagaccgatgtctgacccaggagtattttcacaacatcaagcaacggakgcg

SEQ ID NO: 652 - DNA, 356 bp, Homo Sapiens
  Lymph ganglia
  sig_peptide 285..341: Von Heijne matrix
  score 5.60
  misc_feature 16..347: seq PTLCVSSSPALWA/AS; blastn; identity 98; region 1..332
  id W56567
  misc_feature 15..347: est; blastn; identity 97; region 1..333
  id AA151004
  misc_feature 15..296: est; blastn; identity 99; region 1..282
  id AA147584
  misc_feature 293..338: est; blastn; identity 97; region 280..325
  id AA147584
  misc_feature 53..296: est; blastn; identity 99; region 1..244
  id W07033
  misc_feature 293..337: est; blastn; identity 97; region 242..286
  id W07033
  misc_feature 55..338: est; blastn; identity 94; region 1..284; id H94668; est
aacgcctwtaagacagcggaactaagaaaagaagaggcctgtggacagaacaatcatgtctgactccctggtggtgtgcgaggtagacccagagctaacagaaaagctgakgaaattccgcttccgaaaagagacagacaatgcagccatcataatgaaggtggacaaagaccggcagatggtggtgctggaggaagaatttcagaacatttccccagaggvgctcaaaatggagttgccggagagacagcccaggttcgtggtttacagctacaagtacgtgcatgacgatggccgagtgtcctaccctttgtgtttcatcttctccagccctgtgggctgcaagcgaaacaggg

SEQ ID NO: 653 - DNA, 463 bp, Homo Sapiens
  Umbilical cord
  sig_peptide 65..139: Von Heijne matrix
  score 5.50
  misc_feature 182..352: seq AQLFACLLRLGTQ/QV; blastn; identity 97; region 179..349
  id AA057016
  misc_feature 22..183: est; blastn; identity 97; region 20..181
  id AA057016
  misc_feature 22..183: est; blastn; identity 98; region 23..184
  id AA133917
  misc_feature 182..293: est; blastn; identity 94; region 182..293
  id AA133917
  misc_feature 291..332: est; blastn; identity 90; region 290..331
  id AA133917
  misc_feature 182..308: est; blastn; identity 99; region 119..245
  id R13065
  misc_feature 80..183: est; blastn; identity 97; region 18..121
  id R13065
  est
  misc_feature 25: n=a, g, c or t
attttttgctgcgccaacgcatganccgaagctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaaccagacaagactgcatcacacagatgacgacgga

SEQ ID NO: 654 - DNA, 370 bp, Homo Sapiens
  Umbilical cord
  sig_peptide 68..325: Von Heijne matrix
  score 5.50
  misc_feature 34..282: seq ALLTGPTLGSSQA/RW; blastn; identity 96; region 29..277
  id HUM413F04B
  misc_feature 272..363: est; blastn; identity 97; region 268..359
  id HUM413F04B
  misc_feature 27..181: est; blastn; identity 98; region 1..155
  id R13204
  misc_feature 174..282: est; blastn; identity 94; region 147..255
  id R13204
  misc_feature 275..344: est; blastn; identity 97; region 249..318
  id R13204
  misc_feature 27..282: est; blastn; identity 97; region 1..256
  id R55599
  misc_feature 275..344: est; blastn; identity 95; region 250..319
  id R55599
  misc_feature 27..344: est; blastn; identity 97; region 1..318
  id H23092
  misc_feature 40..282: est; blastn; identity 97; region 1..243
  id C05240
  misc_feature 272..363: est; blastn; identity 97; region 234..325
  id C05240
  unsure -19: est
  position -19 of amino acid sequence
  unsure 5: Xaa = Ala,Pro; position 5 of amino acid sequence; Xaa = Lys,Gln
aacgaacgcacggccgcgcasatctgtcttgctggaactttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcgscgcagaggggaaacggagccttgctaacgggcccaacgctggggagcagccaggccaggtggcgggcgmagacttcgagagckaggacgagggctcctggg

SEQ ID NO: 655 - DNA, 354 bp, Homo Sapiens
  Lymph ganglia
  sig_peptide 244..288: Von Heijne matrix
  score 5.30
  misc_feature 51..195: seq IVSVLALIPXTTT/LT; blastn; identity 96; region 38..182
  id W38899
  misc_feature 197..324: est; blastn; identity 94; region 183..310
  id W38899
  misc_feature complement(207..349): est; blastn; identity 96; region 141..283
  id W93646
  misc_feature complement(58..195): est; blastn; identity 96; region 455..592
  id W93646
  misc_feature 47..195: est; blastn; identity 95; region 32..180
  id W19506
  misc_feature 197..324: est; blastn; identity 94; region 181..308
  id W19506
  misc_feature 197..338: est; blastn; identity 95; region 194..335
  id W52820
  misc_feature 71..195: est; blastn; identity 96; region 69..193
  id W52820
  misc_feature 65..195: est; blastn; identity 96; region 9..139
  id W93906
  misc_feature 207..269: est; blastn; identity 96; region 309..371
  id W93906
  est
  misc_feature 9..10,12: n=a, g, c or t
  unsure -4: position -4 of amino acid sequence
  unsure 10: Xaa = Asp,Glu; position 10 of amino acid sequence; Xaa = Phe,Ile,Leu
agagctgtnncnsaagtaggggagggcggtgctccgcmgmggtggcggdhtgctatcgcttcgcagaacctactcaggcagccagctgagaagagttgagggaaagtgctgctgctgggtctgcaracgcgatggataacgtgcagccgaaaatawaacatcgmcccttctgcttcagtgtgaaargccacgtgayrgawdctgcggctggatattatcaactcactggtaacaacagtattcatgctcatcgtatctgtgttggcactgataccagadaccacaacattgacmgttggtggaggggtgtttgchhttgtgacagcagtatgctgtcttgccgacggggggggg

SEQ ID NO: 656 - DNA, 245 bp, Homo Sapiens
  Lymph ganglia
  sig_peptide 96..182: Von Heijne matrix
  score 5.00
  misc_feature 55..242: seq ELSLLPSSLWVLA/TS; blastn; identity 99; region 25..212
  id AA022775
  misc_feature 55..242: est; blastn; identity 99; region 23..210
  id R77353
  misc_feature 55..242: est; blastn; identity 100; region 16..203
  id W17384
  misc_feature 55..242: est; blastn; identity 98; region 19..206
  id R05902
  misc_feature 55..242: est; blastn; identity 100; region 16..203; id W76289; est
aagagacgtcaccggctgcgcccttcagtatcgcggacggaagatggcgtccgccacccgtctcatccagcggctgcggaactgggcgtccgggcatgacctgcaggggaagctgcagctacgctaccaggagatctccaagcgaactcagcctcctcccaagctccctgtgggtcctagccacaagctctccaacaattactattgcactcgcgatggccgccgggaatctgtgcccccttagg

SEQ ID NO: 657 - DNA, 222 bp, Homo Sapiens
  Umbilical cord
  sig_peptide 49..93: Von Heijne matrix
  score 4.90
  misc_feature 20..220: seq AVVFVFSLLDCCA/LI; blastn; identity 97; region 17..217
  id W24468
  misc_feature 102..220: est; blastn; identity 99; region 75..193
  id H71267
  misc_feature 28..62: est; blastn; identity 100; region 1..35
  id H71267
  misc_feature 68..97: est; blastn; identity 93; region 40..69
  id H71267
  misc_feature 45..220: est; blastn; identity 99; region 3..178
  id W38688
  misc_feature 45..220: est; blastn; identity 98; region 3..178
  id W80906
  misc_feature 52..220: est; blastn; identity 99; region 1..169
  id AA037518
  est
  misc_feature 8..11: n=a, g, c or t
  unsure 14: position 14 of amino acid sequence; Xaa = Asp,Asn
aatccghnnnnggtttgacggaaggagcggcggcgacggaggaggaggatggaggcggtggtgttcgtcttctctctcctcgattgttgcgcgctcatcttcctctcggtctacttcataattacattgtctratttagaatgtgattacattaatgctagatcatgttgctcaaaattaaacaagtgggtaattccagaattgattggccataccattggg

SEQ ID NO: 658 - DNA, 249 bp, Homo Sapiens
  Lymph ganglia
  sig_peptide 79..168: Von Heijne matrix
  score 4.90
  misc_feature 14..197: seq VAHALSLPAQSYG/ND; blastn; identity 98; region 1..184
  id AA043611
  misc_feature 193..251: est; blastn; identity 96; region 179..237; id AA043611; est
agccagtwgagaaggactctgatccggctcagctttccaatcagctgcggaaggagccacgctttcgggggttgcaagatggcggccaccagtggaactgatgagccggtttccggggagttggtgtcwgtggcacatgcgctttctctcccagcacagtcgtatggcaacgatcctgacattgagatggcttgggccatgagagcaatgcagcatgctgaagtctattacaagctgatttcatcagtt

SEQ ID NO: 659 - DNA, 406 bp, Homo Sapiens
  Lymph ganglia
  sig_peptide 275..325: Von Heijne matrix
  score 4.60
  misc_feature 212..349: seq ALFLLLHNEMVSG/VY; blastn; identity 97; region 158..295
  id W48792
  misc_feature 54..181: est; blastn; identity 100; region 2..129
  id W48792
  misc_feature 2..136: est; blastn; identity 95; region 15..149
  id HUM031H01B
  misc_feature 137..222: est; blastn; identity 90; region 149..234
  id HUM031H01B
  misc_feature 207..248: est; blastn; identity 92; region 220..261
  id HUM031H01B
  unsure 6: est
  position 6 of amino acid sequence
  unsure 7: Xaa = Asp,Glu; position 7 of amino acid sequence; Xaa = Arg,Thr
aatctcagctggttggctttggttagagctcccgtcagactttcgttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggasasggggaggtggaaaacggacgatgtattactaagctggaaaacatggggtttcgagtgggac

SEQ ID NO: 660 - DNA, 399 bp, Homo Sapiens
  Lymphocytes
  sig_peptide 22..378: Von Heijne matrix
  score 4.30
  misc_feature 16..307: seq SVCLSIISMLSSC/KE; blastn; identity 99; region 1..292
  id H87111
  misc_feature 92..352: est; blastn; identity 100; region 2..262
  id W02272
  misc_feature 173..400: est; blastn; identity 100; region 2..229
  id W30926
  misc_feature 68..198: est; blastn; identity 92; region 20..150; id R57641; est
acttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccg

SEQ ID NO: 661 - DNA, 425 bp, Homo Sapiens
  Lymph ganglia
  sig_peptide 249..329: Von Heijne matrix
  score 4.10
  misc_feature 265..426: seq VLMFCVTPPELET/KX; blastn; identity 96; region 57..218
  id AA083634
  misc_feature 262..420: est; blastn; identity 91; region 63..221
  id W71503
  misc_feature 265..420: est; blastn; identity 91; region 193..348
  id W55411
  unsure -25: est
  position -25 of amino acid sequence
  unsure 2: Xaa = Ile,Lys,Asn,Arg,Ser
  position 2 of amino acid sequence
  unsure 13: Xaa = Met,Val; position 13 of amino acid sequence; Xaa = Ser,Thr
aagaacatcagaagtatatctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagadmatgacaggctctgaaaattggaaaaccaagaaggttttgatgttttgtgtgacgccacctgaattagaaaccaagrtgaacataaccaaaggtggtctggtgttgtttwcagcaaactcgaattcatcatgtatggagctatcaaagaaaattgcagagcggccagcg

SEQ ID NO: 662 - DNA, 176 bp, Homo Sapiens
  Lymphocytes
  sig_peptide 60..158: Von Heijne matrix
  score 4.10
  misc_feature 18..170: seq LFMTRTLCSPGPS/QP; blastn; identity 94; region 45..197; id AA102765; est
aagacgattggtcgggccacgccagatctcaggatgatggggcgcacctggggtttgccatgcagcacatcgtgggtgtgccccacgtactggttcggaggggcctccttggaagggacctcttcatgaccaggactctctgcagcccaggcccaagccagcccagagaggccggg

SEQ ID NO: 663 - DNA, 302 bp, Homo Sapiens
  Lymph ganglia
  sig_peptide 99..155: Von Heijne matrix
  score 3.80
  misc_feature 33..229: seq ALALASSQSHLLG/RD; blastn; identity 97; region 2..198
  id W87850
  misc_feature 209..298: est; blastn; identity 95; region 179..268
  id W87850
  misc_feature 200..298: est; blastn; identity 100; region 1..99
  id AA043526
  misc_feature 227..298: est; blastn; identity 100; region 1..72
  id H68037
  misc_feature 235..298: est; blastn; identity 100; region 3..66; id N78231; est
aattaagttccgttgtggttcactctggtatatcctctgaaagtgggcattactattcttatgccagaaatatcacaagtacagactcttcatatcagatgtaccaccagtctgaggctctggcattagcatcctcccagagtcatttactagggagagatagtcccagtgcagtttttgaacaggatttggaaaataaggaaatgtcaaaagaatggtttttatttaatgacagtagagtgacatttacttcatttcagtcagtccagaaaattacgagcaggtttccaaaggacacctgg

SEQ ID NO: 664 - DNA, 213 bp, Homo Sapiens
  Umbilical cord
  sig_peptide 52..117: Von Heijne matrix
  score 3.80
  misc_feature complement(61..133): seq FASVAMICAIASG/SE; blastn; identity 98; region 46..118
  id R15459
  misc_feature complement(142..180): est; blastn; identity 100; region 1..39
  id R15459
  est
  misc_feature 141: n=a, g, c or t
  unsure 8: position 8 of amino acid sequence; Xaa =  * ,Asp,Glu,His,Gln,Tyr
aatgggggccgtgtagctggccttctgcctgccagctacacggcccccatcatgagtggccagggcctagcaggcttctttgcctccgtggccatgatctgcgctattgccagtggctcggagctatcagaaagtgccbanggctactttatcacagcctgtgctgttatcattttgaccatcatctgttacctgggcctgccccgccaaggg

SEQ ID NO: 665 - DNA, 264 bp, Homo Sapiens
  Lymph ganglia
  sig_peptide 115..204: Von Heijne matrix
  score 3.70
  misc_feature complement(15..226): seq SMMLLTVYGGYLC/SV; blastn; identity 100; region 1..212
  id N56211
  misc_feature 125..198: est; blastn; identity 98; region 87..160
  id W37072
  misc_feature 72..127: est; blastn; identity 98; region 35..90
  id W37072
  misc_feature 191..245: est; blastn; identity 92; region 152..206
  id W37072
  misc_feature 38..73: est; blastn; identity 97; region 2..37
  id W37072
  misc_feature 125..249: est; blastn; identity 99; region 87..211
  id W37073
  misc_feature 72..124: est; blastn; identity 100; region 35..87
  id W37073
  misc_feature 38..73: est; blastn; identity 97; region 2..37
  id W37073
  misc_feature 52..235: est; blastn; identity 97; region 1..184
  id T84830
  misc_feature 52..127: est; blastn; identity 98; region 1..76
  id AA069888
  misc_feature 125..198: est; blastn; identity 98; region 73..146
  id AA069888
  misc_feature 191..243: est; blastn; identity 94; region 138..190
  id AA069888
  unsure 16: est
  position 16 of amino acid sequence
  unsure 18: Xaa = His,Gln; position 18 of amino acid sequence; Xaa = Ala,Glu
acgagtgctgcgttcggctgtgctgggaagttgcgtagacagtggcctcgagaccctgcctgcctgaggaggcctcggttggatgcgaaggagctgcagcatccaggggacaagatgccaactggcaagcagctagctgacattggctataagaccttctctacctccatgatgcttctcactgtgtatggggggtacctctgcagtgtccgagtctaccactatttccagtggcgcagggcccagcgccasgccgmagaaggg

SEQ ID NO: 666 - DNA, 97 bp, Homo Sapiens
  Lymph ganglia
  sig_peptide 44..85: Von Heijne matrix
  score 3.50
  misc_feature complement(2..95): seq FPVCLTVTAAVCG/XX; blastn; identity 95; region 231..324
  id N32226
  misc_feature complement(2..85): est; blastn; identity 97; region 243..326
  id N32240
  est
  misc_feature 87: n=a, g, c or t
  unsure 1: position 1 of amino acid sequence
  unsure 2: Xaa = Leu,Pro,Gln,Arg; position 2 of amino acid sequence; Xaa = His,Gln
aacacatttctgtatcgccccgtgaagagctctacgcacatgaatgttccccgtctgtttaactgttacggcmgcagtgtgtgggcngcasgcacag

SEQ ID NO: 667 - DNA, 241 bp, Homo Sapiens
  Lymph ganglia
  sig_peptide 95..139: Von Heijne matrix
  score 3.50
  misc_feature 60..240: seq VIFFACVVRVRDG/LP; blastn; identity 97; region 66..246
  id R89543
  misc_feature 60..223: est; blastn; identity 97; region 66..229
  id H59647
  misc_feature 49..205: est; blastn; identity 94; region 34..190
  id N34164
  est
  misc_feature 50: n=a, g, c or t
aaagattgctgaggaggcggcgggtagctggcaggcgccgacttccgaangccgccgtccgggcgaggtgtcctcatgacttctcttgtggaccatgtccgtgatcttttttgcctgtgtggtacgggtaagggatggactgcccctctcagcctctactgatttttaccacacccaagattttttggaatggaggagacggctcaagagtttagccttgcgactggcccagtatccaggg

SEQ ID NO: 668 - DNA, 316 bp, Homo Sapiens
  Lymphocytes
  sig_peptide 50..253: Von Heijne matrix
  score 3.50
  misc_feature 80..256: seq LVLDVVMLLLYLG/IE; blastn; identity 97; region 68..244
  id H46779
  misc_feature 249..312: est; blastn; identity 95; region 238..301
  id H46779
  misc_feature 80..312: est; blastn; identity 98; region 68..300
  id H46081
  misc_feature 73..293: est; blastn; identity 93; region 2..222
  id W07846
  misc_feature 262..312: est; blastn; identity 96; region 192..242
  id W07846
  misc_feature 80..283: est; blastn; identity 97; region 12..215
  id AA022743
  misc_feature 278..312: est; blastn; identity 100; region 256..290
  id AA022743
  unsure -66: est; position -66 of amino acid sequence; Xaa = Lys,Arg,Thr
accctgtttccggcagcgcscgctgctccgggagccgctgtggcagcgtatgctsavggggggactgaagatggcgccgcgaggtaaacggttgtcctccaccccgctggaaatcctgttctttctgaacgggtggtataatgctacctatttcctgctggaacttttcatatttctgtataaaggtgtcctgctaccatatccaacagctaacctagtactggatgtggtgatgctcctcctttatcttggaattgaagtaattcgcctgttttttggtacaaagggaaacctctgccagcgaaagatgccgagg

SEQ ID NO: 669 - DNA, 292 bp, Homo Sapiens
  Lymph ganglia
  sig_peptide 98..205: Von Heijne matrix
  score 3.50
  misc_feature complement(81..293): seq PALTILHLPGTEG/VA; blastn; identity 97; region 33..245
  id HSC1JB122
  misc_feature complement(113..289): est; blastn; identity 97; region 65..241
  id H05810
  misc_feature complement(131..289): est; blastn; identity 98; region 37..195
  id HSC20F042
  misc_feature 245..289: est; blastn; identity 100; region 1..45; id H14940; est
aactctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccacctgccagggacagagggggtggcctcccaactcaccccagccccaaaactctcctctgctgctggctggttagaggttccctttgacgccatcccagccccaggg

SEQ ID NO: 670 - DNA, 266 bp, Homo Sapiens
  Lymph ganglia
  sig_peptide 96..179: Von Heijne matrix
  score 8.40
  misc_feature 96..252: seq LLRLLCLLPTGLP/VR; blastn; identity 98; region 1..157
  id HSU41901
  vrt
  misc_feature 13..14,259: n=a, g, c or t
  unsure 27: position 27 of amino acid sequence; Xaa = Ala,Asp,Gly,His,Ile,Leu,Asn,Pro,Arg,Ser,Thr,Val
agtggatsmwagnnccgtgttggtgaagcctctcctcgcgagcagcgcgcacccctccagagcaccccgcggacccgcacctcggcgtggccaccatggtcaggagagttcagccggatcggaaacagttgccactggtcctactgagattgctctgccttcttcccacaggactgcctgttcgcagcgtggattttaaccgaggcacggacaacatcaccgtgaggcagggggacacagccatcctcagatttctcvnctcaggg

SEQ ID NO: 671 - DNA, 332 bp, Homo Sapiens
  Lymph ganglia
  sig_peptide 180..236: Von Heijne matrix
  score 7.40
  misc_feature 52..327: seq LVFIIGLVGNLLA/LV; blastn; identity 97; region 4..280
  id HUMGPCRB
  misc_feature 293..327: vrt; blastn; identity 94; region 1..35
  id T29782
  est
  misc_feature 7..10: n=a, g, c or t
  unsure 29: position 29 of amino acid sequence; Xaa = Ser,Thr
aacttcnnnnhtggacaactactcacagctactacacwragacccgaatmgagtcactgatatacacctggaccaccaccaatggatatacaaatggcaaacaattttactccgcctctgcaactcctcagggaaatgactgtgacctctatgcacatcacagcacggccaggatagtaatgcctctgcattacagcctcgtcttcatcattgggctcgtgggaaacttactagccttggtcgtcattgttcaaaacaggaaaaaaatcaactctaccaccctctattcaacaaatttggttatttctgatatactttttascaccgtcggg

SEQ ID NO: 672 - DNA, 273 bp, Homo Sapiens
  Umbilical cord
  sig_peptide 61..150: Von Heijne matrix
  score 6.50
  misc_feature 54..272: seq WATLGLLVAGLGG/HD; blastn; identity 97; region 291..509
  id D82060
  misc_feature 82..243: vrt; blastn; identity 98; region 1..162
  id HUMMHCRING
  unsure 28: vrt
  position 28 of amino acid sequence
  unsure 37: Xaa = His,Gln; position 37 of amino acid sequence; Xaa = Asn,Thr
aaaaggcgggactgccacgtccaagcaaaccgggaaaggagaggatcccggagccgcgtgatggccagaggcctgggggccccccactgggtggccgtgggactgctgacctgggcgaccttggggcttctggtggctggactcgggggtcatgacgacctgcacgacgatctgcaagaggacttccatggccacagccacaggcactcacatgaagatttccaccatggccamagccatgcccatggccatggccacamtcacgagagcatg

SEQ ID NO: 673 - DNA, 120 bp, Homo Sapiens
  Cancerous prostate
  sig_peptide 16..84: Von Heijne matrix; score 11.40; seq VLALLLFVHYSNG/DE
acttcctggtgctgcatggtgttcgtgcacctgtacctgggtaacgtgctggcgctgctgctcttcgtgcactacagcaacggcgacgaaagcagcgatcccgggccccarcaccgtgcc

SEQ ID NO: 674 - DNA, 303 bp, Homo Sapiens
  Normal prostate
  sig_peptide 202..288: Von Heijne matrix; score 11.30; seq FLLCIFLICAALA/AQ
aaaagtggaaaatgggaggcatgaaatacatcttttcgttgttgttctttcttttgctagaaggaggcaaaacagagcaagtaaaacattcagagacatattgcatgtttcaagacaagaagtacagagtgggtgagagatggcatccttacctggaaccttatgggttggtttactgcgtgaactgcatctgctcagagaatgggaatgtgctttgcagccgagtcagatgtccaaatgttcattgcctttctcctgtgcatattcctcatctgtgctgccctcgctgcccagaagagtggg

SEQ ID NO: 675 - DNA, 313 bp, Homo Sapiens
  Normal prostate
  sig_peptide 203..280: Von Heijne matrix; score 11.00; seq VLFLFLFWGVSLA/GS
aaggatgctatgcaagtcactaataaaggaagacacggacagatgaacttaaaagagaagctttagctgccaaagattgggaaagggaaaggmcaaaaaagacccctgggctacacggcgtaggtgcagggtttcctactgctgttcttttatgctgggagctgtggctgtaaccaactaggaaataacgtatgcagcagctatggctgtcagagagttgtgcttctcaagacaaaggcaagtcctgtttctttttcttttttggggagtgtccttggcaggttctgggtttggacgttattcggtgaccggg

SEQ ID NO: 676 - DNA, 323 bp, Homo Sapiens
  Hypertrophic prostate
  sig_peptide 117..170: Von Heijne matrix
  score 10.70
  seq LILLALATGLVGG/ET
  misc_feature 67: n=a, g, c or t
aaaacccagcctacctgctgtagctgccgccactgccgtctccgccgccactggwcccccagagcbnmagccccagagcctaggaacctggggcccgctcctcccccctccaggccatgaggattctgcagttaatcctgcttgctctggcaacagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccccgctacggg

SEQ ID NO: 677 - DNA, 264 bp, Homo Sapiens
  Hypertrophic prostate
  sig_peptide 94..147: Von Heijne matrix
  score 10.70
  seq LILLALATGLVGG/ET
  misc_feature 188: n=a, g, c or t
  unsure 14: position 14 of amino acid sequence; Xaa = Cys,Phe,Ser,Tyr
aagaggttgaggtggctgcgggactggaagtcatcgggcagaggtctcacagcagccaagaaacctggggcccgctcctcccccctccaggccatgaggattctgcagttaatcctgcttgctctggcaacagggcttgtagggggagagaccaggatcatcaaggggttcgagtgcaagcctcactnccagccctggcaggcagccctgttcgagaagacgcggctactctgtggggcgacgctcatcgcccccagatggctc

SEQ ID NO: 678 - DNA, 331 bp, Homo Sapiens
  Hypertrophic prostate
  sig_peptide 23..112: Von Heijne matrix
  score 10.60
  seq SLLLAVLVFFLFA/LP
  misc_feature 123: n=a, g, c or t
  unsure 4: position 4 of amino acid sequence
  unsure 5: Xaa =  * ,Ala,Cys,Asp,Glu,Phe,Gly,Ile,Lys,Leu,Asn,Arg,Ser,Thr,Val,Tyr
  position 5 of amino acid sequence
  unsure 6: Xaa = Asn,Ser,Thr
  position 6 of amino acid sequence
  unsure 7: Xaa =  * ,Trp
  position 7 of amino acid sequence
  unsure 8: Xaa =  * ,Cys,Gly,Trp
  position 8 of amino acid sequence
  unsure 27: Xaa = Ala,Pro; position 27 of amino acid sequence; Xaa = Leu,Gln
ctctagaacccgacccaccaccatgaggtcctgcctgtggagatgcaggcacctgagccaaggcgtccagtggtccttgcttctggctgtcctggtcttctttctcttcgccttgccctctdnhavttrrkgdsctcaaacaaagccttccaggcatcaacgcacagagaacattaaagaaaggtctctacwgtccctggcaaagcctaagtcccaggcacccacaagggcaaggaggacaaccatctatgcagagccagtgccagagaacaatgccctcaacacacaaacccagcccaaggcccacaccaccggagacagaaggaaagga

SEQ ID NO: 679 - DNA, 406 bp, Homo Sapiens
  Cancerous prostate
  sig_peptide 167..220: Von Heijne matrix
  score 10.60
  unsure -13: seq XILLALATGLVGG/EI; position -13 of amino acid sequence; Xaa =  * ,Leu
aatgtgggacgtggctttgttctaataagacgaagggtggagtgcaggcttggaaagcaggagagctcagcctacgtctttaatcctcctgcccaccccttggrttctgtctccactgggrctcaagasvaggaccctgggggcccgctcctcccccctccaggccatgaggattctgcagtkaatcctgcttgctctggcaacagggcttgtagggggagagatcaggatcatcaaggggttcgagtgcaagcctcactcccagccctggcaggcagccctgttcgagaagacgcggctactactgtggggcgacgctcatcgcccccagatggctcctgacagcagcccactgcctcaagccccgctacatagttcacctggggcagcacaacctccagaagga

SEQ ID NO: 680 - DNA, 187 bp, Homo Sapiens
  Normal prostate
  sig_peptide 35..148: Von Heijne matrix
  score 10.40
  unsure -3: seq LWLLLKLVSTXWA/VR; position -3 of amino acid sequence; Xaa = Pro,Ser
atactgtttataagcaaccttggttttacatagtatgttggaagagtgtggggctggggttgatttaggatttggaggtgtaaagtttgccagtgagacaccaaaccttctctggctgcttttaaaactkgtaagtaccycttgggctgtaagagtgactttgatcatatttaacaaccaggcaagg

SEQ ID NO: 681 - DNA, 329 bp, Homo Sapiens
  Normal prostate
  sig_peptide 249..317: Von Heijne matrix; score 10.20; seq RCLLLALVAESSS/QT
atctactataaaatcgatagaaaaaaaagttctttatggctactggtcagcttttattcctgatacgcctgaacttggcagcccacagtcagtgtccttgatgactcttasattgaaagacccktcttccaaagacacgtgcctgtgctctgcaagtttkatctgccatcttggaaggctcaaagcagtttctttctgttgctgaagataccagtgaccacagaagggcttttacccccttctccgtaatgatcgcttgcagcattagagagttgcacagatgtctkttgttagctttggtggcggagtcatcctcacagacccacggg

SEQ ID NO: 682 - DNA, 277 bp, Homo Sapiens
  Cancerous prostate
  sig_peptide 182..232: Von Heijne matrix; score 10.20; seq SLVLCLLSATVFS/LQ
agttttttccagctcctgggcgaatcccacatctgtttcaactctccgccgagggcgagcaggagcgagagtgtgtcgaatctgcgagtgaagagggaacsaggggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgcagggtggaagctcggccttcctgtcgcaccaccgccccggg

SEQ ID NO: 683 - DNA, 352 bp, Homo Sapiens
  Hypertrophic prostate
  sig_peptide 17..121: Von Heijne matrix
  score 9.00
  unsure -1: seq AMWWLLLWGVLQX/XP
  position -1 of amino acid sequence
  unsure 1: Xaa = Ala,Gly
  position 1 of amino acid sequence
  unsure 11: Xaa = Leu,Trp; position 11 of amino acid sequence; Xaa = Leu,Pro,Gln
agatgtccagttccagatgcctggacccagagtgtgggggaaatatctctggagaagccctcactccaaaggctgtccaggcgcaatgtggtggctgcttctctggggagtcctccaggsttkgcccaacccggggctccgtcctcttggcchaagagctaccccagcagctgacatcccccgggtacccagagccgtatggcaaaggccaagagagcarcacggacatcaaggctccagagggctttgctgtgaggctcgtcttccaggacttcgacctggagccgtcccaggactgtgcaggggactctgtcacaatctcattcgtcggttcggatccaagccactcggg

SEQ ID NO: 684 - DNA, 450 bp, Homo Sapiens
  Normal prostate
  sig_peptide 151..216: Von Heijne matrix
  score 8.80
  unsure -1: seq LLTLALLGGPTWX/XK
  position -1 of amino acid sequence
  unsure 1: Xaa = Ala,Glu
  position 1 of amino acid sequence
  unsure 31: Xaa = Gly,Arg; position 31 of amino acid sequence; Xaa = Leu,Arg
aagagccccacggccagctccttcctgttcccctggcggcccctcgcttcttccttctggatgggggcccagggggccaggagagtataaasgsgwkdkggargggtgcccggcacaaccagacgcccagtcacaggcgagagccctgggatgcaccggccagaggccatgctgctgctgctcacgcttgccctcctggggggccccacctgggmasggaagatgtatggccctggaggaggcaagtatttcagcaccactgaagactacgaccatgaaatcacagggctgcgggtgtctgtaggtcktctcctggtgaaaagtgtccaggtgaaacttggagactcctgggacgtgaaactgggaggccttaggtgggaatacccaggaagtcaccctgcagccaggcgaatacatcacaaaagtctttgtcgcttccaagctttcctc

SEQ ID NO: 685 - DNA, 181 bp, Homo Sapiens
  Prostate
  sig_peptide 5..49: Von Heijne matrix; score 8.60; seq SVSLALLSGWVGS/RQ
agacatggtaagtgtgagtttagcgctgctgtccggatgggttggtagcagacagggtggagtagggttaagcacactggtcaccttaggattggtttcctggtgctggagaatggttaggacacaggccttggaaggttttttgagtgtgaaatattactcagcgttttctgcagacctg

SEQ ID NO: 686 - DNA, 293 bp, Homo Sapiens
  Prostate
  sig_peptide 129..275: Von Heijne matrix
  score 8.50
  unsure -40: seq IVFLLLRVSPCLG/PS
  position -40 of amino acid sequence
  unsure 3: Xaa = Cys,Ser; position 3 of amino acid sequence; Xaa = His,Gln
aagatatcactgtcttgttttcacttagatcctacttacaaagtgagggttattaacagaataaagccttcctttaaagctttataataatcatatttattaataatgctgttgtgcatacttatagtatgcatatattcagcatatgttgcatgtsttcagaattacataagatgaaatccctttcattgcaacttgcaagtgagaaaagatccttagtggctctggtggaagaaatagtatttcttcttctcagggtgtctccctgccttggcccctcccabaagccccgg

SEQ ID NO: 687 - DNA, 323 bp, Homo Sapiens
  Normal prostate
  sig_peptide 258..308: Von Heijne matrix; score 8.30; seq VSALLMAWFGVLS/CV
agcgccgagctgaccgggcgacgccgcgggaggttctggaaacgccgggagctgcgagtgtccagacatccttgtggaaccaggcgttgtktttccttggcagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcagaccggg

SEQ ID NO: 688 - DNA, 235 bp, Homo Sapiens
  Normal prostate
  sig_peptide 92..157: Von Heijne matrix
  score 8.30
  unsure 3: seq LLLPLMLMSMVSS/SL; position 3 of amino acid sequence; Xaa = Ile,Asn
agacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgawtccaggggtcgccagaggccacagggaccgaggccaggcttctaggagatggctccaggaaggcggactg

SEQ ID NO: 689 - DNA, 365 bp, Homo Sapiens
  Cancerous prostate
  sig_peptide 159..224: Von Heijne matrix; score 8.30; seq LLLPLMLMSMVSS/SL
actgttctcgccctcaaatgggaacgctgacctgggactaaagcatagaccaccaggctgagtatcctgacctgagtcatccccagggatcaggagcctccagcagggaaccttccattatattcttcaagcaacttacagctgcaccgacagttgcgatgaaagttctaatctcttccctcctcctgttgctgccactaatgctgatgtccatggtctctagcagcctgaatccaggggtcgccagaggccacagggaccgaggccaggcttctaggagatggctccaggaaggcggccaagaatgtgagtgcaaagattggttcctgagagccccgagaagaaaattcatgacagtgtctggg

SEQ ID NO: 690 - DNA, 146 bp, Homo Sapiens
  Cancerous prostate
  sig_peptide 99..140: Von Heijne matrix; score 8.20; seq LLLLQLSLPSPTS/SP
aaaaatgatgtcactgggaactgcagtcatttgaaaagatagcaatcaagcatttctttcagagccctgttcatctttcagtggctttgcttctcctgatgcttttgctccttcaattatctctgccttctcccacctcctctccg

SEQ ID NO: 691 - DNA, 105 bp, Homo Sapiens
  Normal prostate
  sig_peptide 25..75: Von Heijne matrix; score 8.10; seq LSFKLLLLAVALG/FF
agcccctgctgctctgggcagacgatgctgaagatgctctcctttaagctgctgctgctggccgtggctctgggcttctttgaaggagatgctaagtttggggaa

SEQ ID NO: 692 - DNA, 344 bp, Homo Sapiens
  Hypertrophic prostate
  sig_peptide 138..203: Von Heijne matrix
  score 8.00
  unsure -5: seq LLTLALLGXXXWA/GK
  position -5 of amino acid sequence
  unsure -4: Xaa = Asp,Gly
  position -4 of amino acid sequence
  unsure -3: Xaa = Pro,Thr; position -3 of amino acid sequence; Xaa = Asn,Thr
agctccttcctgttcccctggcggcccctcgcttcttccttctggatgggggcccagggggcccaggagagtataaaggcgatgtggagggtgcccggcacaaccagacgcccagtcacagggcggagagchstgrgatgcaccggccagaggccatgctgctgctgctcacgcttgccctcctgggggrcmccamctgggcagggaagatgtatggccctggaggaggcaagtatttcagcaccactgaagactacgaccatgaaatcacagggctgcgggtgtctgtaggtcttctcctggtgaaaagtgtccaggtgaaacttggagactcctgggacgtg

SEQ ID NO: 693 - DNA, 267 bp, Homo Sapiens
  Normal prostate
  sig_peptide 58..105: Von Heijne matrix; score 8.00; seq VSAVLCVCAAAWC/SQ
aagagcagggctgcatttccagcaggagctgcgagcacagtgctggctcacaacaagatgctcaaggtgtcagccgtactgtgtgtgtgtgcagccgcttggtgcagtcagtctctcgcagctgccgcggcggtggctgcagccggggggcggtcggacggcggtaattttctggatgataaacaatggctcaccacaatctctcagtatgacaaggaagtcggacagtggaacaaattccgagacgatgattatttccgcactggg

SEQ ID NO: 694 - DNA, 258 bp, Homo Sapiens
  Normal prostate
  sig_peptide 124..174: Von Heijne matrix; score 7.80; seq VLWLISFFTFTDG/HG
aagcataagaagtgattgagccacaagtatactgaaggaagggctccctcgagttgtggtgtgaagagataaatcaccagtcacagactatgcacccgactgctgctgttcagtccagggaaaatgaaagttggagtgctgtggctcatttctttcttcaccttcactgacggccacggtggcttcctggggaaaaatgatggcatcaaaacaaaaaaagaactcattgtgaataagaaaaaacatctaggcctcggg

SEQ ID NO: 695 - DNA, 211 bp, Homo Sapiens
  Normal prostate
  sig_peptide 155..202: Von Heijne matrix; score 7.70; seq ILLDLICLLFITA/CV
actgaaataggaaagtaagatttatacccattattcagccaaaatctgtttttctttaacttctacccattgttcctaagtctgccctctgggggctgtagaaaataatgaagatgatgttattaatgataaccagtgcttgctgtaaccagttatgtgcattattttattggatttaatttgtttactctttataacagcatgtgtgggg

SEQ ID NO: 696 - DNA, 316 bp, Homo Sapiens
  Normal prostate
  sig_peptide 131..307: Von Heijne matrix; score 7.60; seq FMVFGSFFPLISC/QP
acatggattgatttgttatttggggattaaattaggcagggcacatagtagggcctccttggatgtttgatggctgttgaatgaacgtaagtgaatctgttcagttttagggttttattgcatttttgatatggattgtgccagtatatctgtaaagttcacttctatggctaccatgcatgacttgagtcagttctgggcttctagaggagaggttacaaactggtggccagtaggacaaactagcctaccactgttttatttggctttcatggtgtttggttctttttttcctttaatttcctgccagcccggg

SEQ ID NO: 697 - DNA, 317 bp, Homo Sapiens
  Hypertrophic prostate
  sig_peptide 147..206: Von Heijne matrix
  score 7.60
  seq LVVLFGITAGATG/AK
  misc_feature 266,302: n=a, g, c or t
  unsure 31: position 31 of amino acid sequence
  unsure 32: Xaa =  * ,Gly,Leu,Arg,Val; position 32 of amino acid sequence; Xaa =  * ,Cys,Arg,Ser,Trp
acttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctngccaacaagaaggtgggacagttgcacgaabkahgnttagaccggatctgg

SEQ ID NO: 698 - DNA, 282 bp, Homo Sapiens
  Normal prostate
  sig_peptide 46..90: Von Heijne matrix; score 7.60; seq CVLVLAAAAGAVA/VF
aagcggctggtccccggaagttggacgcatgcgccgtttctctgcatggtgtgcgttctcgttctagctgcggccgcaggagctgtggcggttttcctaatcctgcgaatatgggtagtgcttcgttccatggacgttacgccccgggagtctctcagtatcttggtagtggctgggtccggtgggcataccactgagatcctgaggctgcttgggagcttgtccaatgcctactcacctagacattatgtcattgctgacactgatgaaatgagtgccacg

SEQ ID NO: 699 - DNA, 293 bp, Homo Sapiens
  Cancerous prostate
  sig_peptide 48..179: Von Heijne matrix; score 7.50; seq LMIPLLLLTPITA/TS
acaactcaagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccacttcaaggtggcccgagatcggagtagtggctatccgctcacaattgagggctttgcatacctgtggtcaggagcccgtgccagctatggggtcagaaggggccgcg

SEQ ID NO: 700 - DNA, 340 bp, Homo Sapiens
  Normal prostate
  sig_peptide 32..100: Von Heijne matrix
  score 7.50
  unsure 16: seq LTFLQLLLISSLP/RE
  position 16 of amino acid sequence
  unsure 50: Xaa = Asn,Thr
  position 50 of amino acid sequence
  unsure 69: Xaa = Ala,Glu; position 69 of amino acid sequence; Xaa = Lys,Thr
agtagacgctcgggcaccagcmgcggcaaggatggagctgggttgctggacgcagttggggctcacttttcttcagctccttctcatctcgtccttgccaagagagtacacagtcattaatgaagcctgccctggagcagagtggamtatcatgtgtcgggagtgctgtgaatatgatcagattgagtgcgtctgccccggaaagagggaagtcgtgggttataccatcccttgctgcaggaatgaggmgaatgagtgtgactcctgcctgatccacccaggttgtaccatctttgaaaactgcamgagctgccgmaatggctcatgggggggtaccttg

SEQ ID NO: 701 - DNA, 351 bp, Homo Sapiens
  Hypertrophic prostate
  sig_peptide 112..192: Von Heijne matrix
  score 7.20
  seq SLLFFLLLEGGXT/EQ
  misc_feature 73..76,204: n=a, g, c or t
  unsure -25: position -25 of amino acid sequence
  unsure -2: Xaa = Glu,Lys
  position -2 of amino acid sequence
  unsure 4: Xaa =  * ,Glu
  position 4 of amino acid sequence
  unsure 43: Xaa = Lys,Asn,Thr; position 43 of amino acid sequence; Xaa = Asp,Asn
aagacctcggaacgagagcgccccggggagctcggagcgcgtgcacgcgtggcavacggagaaggcvakkrcnnnnrcttgaaggttctgtcaccttttgcagtggtccaaatgagaraaaagtggaaaatgggaggcatgaaatacatcttttcgttgttgttctttcttttgctagaaggaggckaaacagagcaagtramncattcagagacatattgcatgtttcaagacaagaagtacagagtgggtgagagatggcatccttacctggaaccttatgggttggtttactgcgtgaactgcatctgctcagagratgggaatgtgctttgcagccgagtcagatgt

SEQ ID NO: 702 - DNA, 310 bp, Homo Sapiens
  Hypertrophic prostate
  sig_peptide 68..124: Von Heijne matrix; score 7.20; seq VSIMLLLVTVSDC/AV
aaaggctgagcgggaggaagcgagaggcatctaagcaggcagtgttttgccttcaccccaagtgaccatgagaggtgccacgcgagtctcaatcatgctcctcctagtaactgtgtctgactgtgctgtgatcacaggggcctgtgagcgggatgtccagtgtggggcaggcacctgctgtgccatcagcctgtggcttcgagggctgcggatgtgcaccccgctggggcgggaaggcgaggagtgccaccccggcagccacaagatccccttcttcaggaaacgcaagcaccacacctgtccttgcttg

SEQ ID NO: 703 - DNA, 380 bp, Homo Sapiens
  Normal prostate
  sig_peptide 240..302: Von Heijne matrix
  score 7.20
  unsure 12: seq SALLFSLLCEAST/VV
  position 12 of amino acid sequence
  unsure 17: Xaa = Pro,Arg
  position 17 of amino acid sequence
  unsure 19: Xaa = Ala,Thr; position 19 of amino acid sequence; Xaa = Ile,Asn
acctttctggacgttgcaaactgtgacatataaaagctgttagctgctcctctagccagcagcattcaaaccttgcagagctttgctctcagagagtttgtaaaaagacacactcctcttacaagagttcatgctaccacatagcaaagaaccttaaatttttggaagaacaatatattcattttggcattgtgcagagcaaagtaaactcggtggcctcttcttctccacccctcaaratgatagcratctctgccgtcagcagtgcactcctgttctcccttctctgtgaagcaagtaccgtcgtcctactcaattccactgactcatccccgcsaaccaataatttcrctgatawtgaagcagctctgaaagcacat

SEQ ID NO: 704 - DNA, 435 bp, Homo Sapiens
  Hypertrophic prostate
  sig_peptide 181..243: Von Heijne matrix
  score 7.20
  unsure 63: seq SALLFSLLCEAST/VV; position 63 of amino acid sequence; Xaa = Pro,Thr
agcattcaaaccttgcagagctttgctctcagagagtttgtaaaaagacacactcctcttacaagagttcatgctaccacatagcaaagaaccttaaatttttggaagaacaatatattcmattttggcattgtgcagagcaaagtaaactcggtggcctcttcttctccacccctcaaaatgatagcaatctctgccgtcagcagtgcactcctgttctcccttctctgtgaagcaagtaccgtcgtcctactcaattccactgactcatccccgccaaccaataatttcactgatattgaagcagctctgaaagcacaattagattcagcggatatccccaaagccaggcggaagcgctacatttcgcagaatgacatgatcgccattcttgattatcataatcaagttcggggcaaagtgttcccamcggca

SEQ ID NO: 705 - DNA, 426 bp, Homo Sapiens
  Cancerous prostate
  sig_peptide 352..417: Von Heijne matrix; score 7.20; seq LLTLVLCVAVAYE/RQ
attgagctgtctgcagcagagctgagaggaccagccattttacttatggaaaacagtgtggcatattctgctgagcttcgccctggaagaagcctcttttatacatctcttcagggaagagagaagcaatgggcatgttagtatacaatgatcacagccacgcaggcctgcaagctgccttttggacaggctgttgactgccgttccaattagctgattggagaatgtggaatgcagagtgataatgctgcatatctgctatcaggcagcagcaaaggtttttgtcttgggaaggcaagctttccctgcaatattatctcagcagctccctagctgcttaccctgaaaacgatggatccaaacggagggtgttgcactctgctaacgctggtcctgtgcgtggctgtggcatatgagcggcaggag

SEQ ID NO: 706 - DNA, 389 bp, Homo Sapiens
  Cancerous prostate
  sig_peptide 288..362: Von Heijne matrix; score 7.20; seq LFTFSTSLPSSLS/SS
acaatacctgttacttatatacttttctttgtctaaaaaagaaataagatctgtctagatgactgattaacttagggagattctgattaacagaatttctagaaatggctttcagcaggcaaagagaaaattatattttgtaccaatttatataaagttcatctagctcagcttttggagatgtccctggggctagagatgaaatatcgttttcctgtccacagacagcggtctgcagttcaccccatgaactcatacaggtcagaattaaaccccgagctttgtttatggagggtgagatatatttccaagtatttctttctcttttcacattttccacatcattaccatcatcattgtcgtcatcatcattgtcatcatccaatggg

SEQ ID NO: 707 - DNA, 328 bp, Homo Sapiens
  Normal prostate
  sig_peptide 194..316: Von Heijne matrix; score 7.00; seq FLCMLAAIDLALS/TS
atgagtcagcctgaaaggaacaggccgaactgctgtatgggctctactgccagtgtgacctcaccctctccagtcacccctcctcagttccagctatgagttcctgcaacttcacacatgccacctttgtgcttaatkggaatcccagggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatg

SEQ ID NO: 708 - DNA, 267 bp, Homo Sapiens
  Normal prostate
  sig_peptide 79..207: Von Heijne matrix
  score 7.00
  unsure -39: seq PWFLAPWCPGTQS/NR; position -39 of amino acid sequence; Xaa = Asn,Thr
acccttcgttctggttctggttctagttctggttctaacaactcacaatccctttagctttctctcccctccctttgaatgagagaaactamcccgcttccgaagcccctgaaagacactgctccttcctctcatggagttggctccgacagcccgtctgccaccaggccatggttccttgccccatggtgtcctgggacccagagcaacaggatctgtcacccacctctctcttctcccccagatcaagcgacgtgcctcagaggc

SEQ ID NO: 709 - DNA, 301 bp, Homo Sapiens
  Normal prostate
  sig_peptide 23..202: Von Heijne matrix
  score 7.00
  unsure 30: seq VLVVLALRSLGRS/CS; position 30 of amino acid sequence; Xaa =  * ,Tyr
aagtgaggcttggaaaggcgtcatggacagacctgggtcgctttctgtcttcgggtccctcccggcttcgctcgggacctggctctcaagcccagcttggctggtggacagaccggtgcgctctgcacacccgagtgcgaattccaccggcgtgagaatgagcgtgctcgtggtcctggccctgaggtccctgggtcgcagctgttccctctcccaggctgccccctccaggtggacgcggtcaaacgatgccccgcagcctcctgggtctcagcacatattccacacctahgtscccggg

SEQ ID NO: 710 - DNA, 110 bp, Homo Sapiens
  Normal prostate
  sig_peptide 3..65: Von Heijne matrix
  score 7.00
  unsure 9: seq VILLFSYPSCCLC/FL; position 9 of amino acid sequence; Xaa = Asn,Tyr
atatgcattattttgttgctgggaaagtaatccttctcttctcttatccatcatgttgtttgtgtttcttggtgtacaggagagtaagcwatttatttaagtgctttgag

SEQ ID NO: 711 - DNA, 318 bp, Homo Sapiens
  Cancerous prostate
  sig_peptide 160..216: Von Heijne matrix
  score 7.00
  seq STVVLQVLTQATS/QD
  misc_feature 124: n=a, g, c or t
agacgccaracatggcgtgttcctagaagccgctttcggcatcagtaggcggcggcgtggggtctggcakcgtggggagagggamcaaccgacgccacttcgtgttgggaagtgggagcggganrgccgggcaattcccgaccgaaccaaacggtttccatggatctcaatagtgccagcactgttgttcttcaggtgttaacacaggccaccagtcaggatactgctgtgttaaaaccagctgaggagcagttgaagcagtgggagacacagccaggwttctattcagtgttgctgaatattttcaccaaccacggg

SEQ ID NO: 712 - DNA, 325 bp, Homo Sapiens
  Normal prostate
  sig_peptide 95..313: Von Heijne matrix; score 7.00; seq FLCMLAAIDLALS/TS
atgagtcagcctgaaagaacaggccgaactgctgtatgggctctactgccagtgtgacctcaccctctccagtcacccctcctcagttccagctatgagttcctgcaacttcacacatgccacctttgtgcttattggtatcccaggattagagaaagcccatttctgggttggcttccccctcctttccatgtatgtagtggcaatgtttggaaactgcatcgtggtcttcatcgtaaggacggaacgcagcctgcacgctccgatgtacctctttctctgcatgcttgcagccattgacctggccttatccacatccaccatg

SEQ ID NO: 713 - DNA, 415 bp, Homo Sapiens
  Cancerous prostate
  sig_peptide 179..346: Von Heijne matrix; score 6.90; seq PLFFSCSISATHS/CV
acaaaatcaagaaaatccaacatagatggtcaaaatattcataggtgactgagagtatccaaatgggccaggtgactgagaatacgcaaacaggccagaataatatctgtgttaaatttgaccctctattttattaacatatctgtcatgacctttctctgtacctgctgtagtactcatgtatagactcagtcttatagcaggccctgggtcctatcctgtgctaagatggggagtttgggacatccctagttcattagttcaagtgacttaccatcagcccaacctcactacaaatttggatctgcctttgttcttcagttgtagtatctcggctacccattcttgtgtcaagcctccatctgtaattattggtatctcttctttcctgagctttccttatcaaactttggta

SEQ ID NO: 714 - DNA, 400 bp, Homo Sapiens
  Normal prostate
  sig_peptide 128..199: Von Heijne matrix; score 6.90; seq LCFLLLAVAMSFF/GS
aagttggtgagcttttccggtgctctgcacagatgctggggcgctgagcaaacagccctcagtttctggagctgttccgagtcccgtggagtctccatctgagccctttcctagtccaggcatcccgatgttggtggatggcccatctgagcggccagccctgtgcttcttgctgttggctgtggcaatgtctttcttcggctcagctctatccatagatgaaacacgggcgcatctgttgttgaaagaaaagatgatgcggctgggggggcggctggtgctgaacaccaaggaggagctggccaatgagaggctcatgacgctcaaaatcgctgagatgaaggaggccatgaggaccctgatattcccacccagcatgcactttttccaggccaaatgg

SEQ ID NO: 715 - DNA, 212 bp, Homo Sapiens
  Cancerous prostate
  sig_peptide 33..137: Von Heijne matrix
  score 6.90
  unsure -20: seq XLXXLLTPPPSYG/HQ
  position -20 of amino acid sequence
  unsure -19: Xaa = Cys,Gly
  position -19 of amino acid sequence
  unsure -16: Xaa = His,Gln
  position -16 of amino acid sequence
  unsure -13,-11: Xaa = Leu,Pro
  position -13, -11 of amino acid sequence
  unsure -10: Xaa = Ala,Val
  position -10 of amino acid sequence
  unsure 11: Xaa = Asp,Glu; position 11 of amino acid sequence; Xaa = Ala,Ser,Thr
aaccggcccgcgccccgccatggaggacctggatgccctgctctctgacctggagactaccacctcgcacatgccaakgtcakgggctycyaaagagcgyycttgyggabctkctcacccctcccccatcctatggccaccagccacagacagggtctggggagtctdcaggagcctcgggggacaaggaccacctgtacagcacggtatgc

SEQ ID NO: 716 - DNA, 269 bp, Homo Sapiens
  Normal prostate
  sig_peptide 15..137: Von Heijne matrix
  score 6.80
  unsure -39: seq LFLFLTSIAEXCS/TP
  position -39 of amino acid sequence
  unsure -26: Xaa = Phe,Ile,Val
  position -26 of amino acid sequence
  unsure -16: Xaa = Cys,Phe,Gly,Val
  position -16 of amino acid sequence
  unsure -3: Xaa = Asp,Glu
  position -3 of amino acid sequence
  unsure 8: Xaa = Cys,Tyr; position 8 of amino acid sequence; Xaa = Phe,Leu
accctgtkcttktcatggttdtctggctcgtcttatttgctcttcagatttactcctatkkyagtactcgagatcagcctgcatcacgtgakaggcttcttttcctttttctgacaagtattgcggaatrctgcagcactccttactctcttttgggtttkgtcttcacggtttcttttgttgccttgggtgttctcacactctgcaagttttacttgcagggttatcgagctttcatgaatgatcctgccatgaatcggggaggtgcg

SEQ ID NO: 717 - DNA, 68 bp, Homo Sapiens
  Hypertrophic prostate
  sig_peptide 9..62: Von Heijne matrix
  score 6.70
  unsure -9: seq LPLLXXXSLPVGA/WL
  position -9 of amino acid sequence
  unsure -8: Xaa = His,Leu,Pro,Gln
  position -8 of amino acid sequence
  unsure -7: Xaa =  * ,Leu,Gln; position -7 of amino acid sequence; Xaa = Leu,Met
aagtcctgatggcccggcatgggttaccgctgctgchbywghtgtcgctcccggtcggcgcgtggctc

SEQ ID NO: 718 - DNA, 407 bp, Homo Sapiens
  Cancerous prostate
  sig_peptide 258..368: Von Heijne matrix; score 6.70; seq ILYILWYCSVCSS/GS
aaggttggtctggaccggaagcgaagatggcgacttctggcgcggcctcggcggastggtgatcggctggtgcatattcggcctcttactactggckattttggcattctgctggatatatgttcgtaaataccaaagtcggcgggaaagtgaagttgtctccaccataacagcaattttttctctagcaattgcacttatcacatcagcacttctaccagtggatatatttttggtttcttacatgaaaaatcaaaatggtacatttaaggactgggctaatgctaatgtcagcagacagattgaggacactgtattatacggttactatactttatattctgtggtattgttctgtgtgttcttctggatcccttttgtctacttctattatgaagaaaaggatg

SEQ ID NO: 719 - DNA, 348 bp, Homo Sapiens
  Cancerous prostate
  sig_peptide 196..240: Von Heijne matrix; score 6.70; seq ILSTVTALTFARA/LD
aaaaaattggtcccagttttcaccctgccgcagggctggctggggagggcagcggtttagattagccgtggcctaggccgtttaacggggtgacacgagchtgcagggccgagtccaaggcccggagataggaccaaccgtcaggaatgcgaggaatgtttttcttcggactctatcgaggcacacagacagaccatggggattctgtctacagtgacagcbttaacatttgccagagccctggacggctgcagaaatggcattgcccaccctgcaagtgagaagcacagactcgagaaatgtagggaactcgagagcagccactcggccccaggatcaacccagcag

SEQ ID NO: 720 - DNA, 146 bp, Homo Sapiens
  Normal prostate
  sig_peptide 45..113: Von Heijne matrix
  score 6.50
  unsure -8: seq LTFLQXLLISSLX/RE
  position -8 of amino acid sequence
  unsure -1: Xaa = Leu,Val; position -1 of amino acid sequence; Xaa = Leu,Pro,Gln
actctccctccccagtagacgctcgggcaccagccgcggcaaggatggagctgggttgctggacgcagttggggctcacttttcttcagstccttctcatctcgtccttgchaagagagtacacagtcattaatgaagchcgcaag

SEQ ID NO: 721 - DNA, 308 bp, Homo Sapiens
  Prostate
  sig_peptide 201..266: Von Heijne matrix
  score 6.40
  unsure -9: seq FLLCXSVFTDCKG/DV; position -9 of amino acid sequence; Xaa = Cys,Ser
acagaatcacgttttdagttgtgcgtgtgcgcgcacacgmgtgtaaamagcactttcgattgtgcctcctgttttctcgagtggggacactttaactacagtttasacctcgggcgcatmaagtttktcttctctttctctctggttrtttctgtttctgagtggaccaacagcagarcccacgaggakttgttttgagtatggagctgttgcgggtdtgctcctttttcttgctttgctsctcagtttttacagactgtaaaggagatgtgttgtgtgtgaagatggagcagagtcaaatctgtgct

SEQ ID NO: 722 - DNA, 289 bp, Homo Sapiens
  Normal prostate
  sig_peptide 203..268: Von Heijne matrix; score 6.30; seq TWFLLLPPGQCRA/VG
agaatctcacgagagaagaaaaccagccacataaaggatttgaaagctcaacttgctttcccactctgttatccctggagttggcttggattcaccctgaagccttccccctcccggggaaagttgcttcacgttgcagctcagcaggtttgtccagctacataggctccagaaaacaagaagcaagactggaaagctggggatgattgtacgccctcgcctgaatcttacgtggttcctccttcttccacctggccagtgcagagccgtgggtgccacgtggcccggg

SEQ ID NO: 723 - DNA, 120 bp, Homo Sapiens
  Normal prostate
  sig_peptide 1..57: Von Heijne matrix; score 6.30; seq MVALCCCLWKISG/CE
atgcaattcttgtttaagatggtggccttatgctgttgtctctggaagatctccggctgtgaggaagtccctctaacttacaacctgctcaagtgcctcctagataaagcgcacgtaggg

SEQ ID NO: 724 - DNA, 247 bp, Homo Sapiens
  Cancerous prostate
  sig_peptide 50..112: Von Heijne matrix
  score 6.30
  unsure -7: seq CVCAAAXXSQSLX/XX
  position -7 of amino acid sequence
  unsure -6: Xaa =  * ,Leu,Trp
  position -6 of amino acid sequence
  unsure -1: Xaa = Cys,Trp
  position -1 of amino acid sequence
  unsure 1: Xaa = Ala,Gly
  position 1 of amino acid sequence
  unsure 2: Xaa = Ala,Thr
  position 2 of amino acid sequence
  unsure 26: Xaa = Ala,Ser
  position 26 of amino acid sequence
  unsure 34: Xaa = Arg,Thr
  position 34 of amino acid sequence
  unsure 36: Xaa = Phe,Val
  position 36 of amino acid sequence
  unsure 44: Xaa = Lys,Gln; position 44 of amino acid sequence; Xaa = Asp,Tyr
aaagcgtcctatccggagccaactgtagctgggatccagcgagaggaagatgctcaaggtgtcagccgtactgtgtgtgtgtgcagccgcttdgtgsagtcagtctctcgsmrctkccgcggcggtggctgcagccggggggcggtcggacggcggtaattttctggatgataaacaatggctcaccasratctctcagtatgacaaggaaktcggmmagtggaacaaattccgagacgatkattat

SEQ ID NO: 725 - DNA, 294 bp, Homo Sapiens
  Hypertrophic prostate
  sig_peptide 124..186: Von Heijne matrix; score 6.30; seq MVALCCCLWKISG/CE
aagacgctgcctttagggagagataaaaagcataatgacattagctaggaaagttaattttcagttcttactgaagtgctgtatgaaactgaaatttccaaggaactgaattttgtgagccaaatgagcatgcaattcttgtttaagatggtggccttatgctgttgtctctggaagatctccggctgtgaggaagtccctctaacttacaacctgctcaagtgcctcctagataaagcgcactgtgtactcctgacaccttgtggttacatcttttccttgatcagtccaggg

SEQ ID NO: 726 - DNA, 173 bp, Homo Sapiens
  Normal prostate
  sig_peptide 114..164: Von Heijne matrix; score 6.20; seq LWILLGSLSCRTS/NR
aattcttataggtgtgtccagcaggcagtggcttgtagctgttccttcagccacttaacaggtttgatttcaaagctttttaatagagaaactaacatgtttggaggggattcatggcccaacatttatggattttgttgggaagtctcagttgccgaacaagcaaccggcgg

SEQ ID NO: 727 - DNA, 242 bp, Homo Sapiens
  Normal prostate
  sig_peptide 66..149: Von Heijne matrix
  score 6.10
  seq LYLFSGFWTFXLG/KF
  misc_feature 89: n=a, g, c or t
  unsure -24: position -24 of amino acid sequence
  unsure -21: Xaa = Glu,Lys
  position -21 of amino acid sequence
  unsure -18: Xaa = Phe,Leu
  position -18 of amino acid sequence
  unsure -3: Xaa = Lys,Arg
  position -3 of amino acid sequence
  unsure 7: Xaa = Leu,Val
  position 7 of amino acid sequence
  unsure 10: Xaa =  * ,Trp
  position 10 of amino acid sequence
  unsure 11: Xaa = Ile,Met
  position 11 of amino acid sequence
  unsure 23: Xaa = Cys,Gly; position 23 of amino acid sequence; Xaa = Glu,Val
acacttgarttggggttaagttgaagaacagacaaacttagacacaaagctatgcaaaaattgtgatgaacaaggaaraagtaagtttngaaaggaragcacaggtcagattatatttattctcaggattttggacttttktattagggaaatttaaacaaggggaatgrtcttatatkkgtattctagaaagattactgtggcagcagcagtatgwaggatggcttgtaggrgataagaga

SEQ ID NO: 728 - DNA, 439 bp, Homo Sapiens
  Normal prostate
  sig_peptide 200..361: Von Heijne matrix
  score 6.00
  seq IVFIFLILLNTAA/QV
  misc_feature 226: n=a, g, c or t
  unsure -46: position -46 of amino acid sequence; Xaa = His,Gln
attgaaagatggtaaaatggtgcagaaggggacttacactgagttcctaaaatctggtatagattttggctcccttttaaagaaggataatgaggaaagtgaacaacctccagttccaggaactcccacamyaagggaatcgtacccttctcagagtcttcggtttggtctcaacaatcttctagaccctccttgaaagatggtgctctggagagccaagatacanmggaatgtcccagttacactatcagaggagaaccgttctgaaggaaaagttggttttcaggcctataagaattacttcagagctggtgctcactggattgtcttcattttccttattctcctaaacactgcagctcaggttgcctatgtgcttcaagattggtggctttcatactgggcaaacaaacaaagtatgctaaatgtcactgtaaat

SEQ ID NO: 729 - DNA, 232 bp, Homo Sapiens
  Normal prostate
  sig_peptide 125..178: Von Heijne matrix
  score 6.00
  seq FTSVLWLTSPSQP/NT
  misc_feature 169: n=a, g, c or t
  unsure -15: position -15 of amino acid sequence; Xaa =  * ,Tyr
atgtagtgaataaagtttgagaaccactgacttgaactttagcatgatttgatacacagggtcctctgtaatcgtacttcgttctgctttaaggctgttgggctgtctcctccaacccatcckkatgttgttgtaktttttcacctckgtcctttggcttacgtcaccntcccaacctaatacctgcccttctagtcttctgtgtacttatccaaatctaaaccctccatgg

SEQ ID NO: 730 - DNA, 229 bp, Homo Sapiens
  Cancerous prostate
  sig_peptide 140..205: Von Heijne matrix; score 5.90; seq IILGCLALFLLLQ/RK
aacagttacgaaggagagctgcaaaagttgcagcagaaaggttgggagtcccgacaggttccgtagcccacagaaaagaagcaagggacggcaggactgtttcacacttttctgcttctggaaggtgctggacaaaaacatggaactaatttccccaacagtgattataatcctgggttgccttgctctgttcttactccttcagcggaagaatttgcgcagaccctgg

SEQ ID NO: 731 - DNA, 292 bp, Homo Sapiens
  Normal prostate
  sig_peptide 134..274: Von Heijne matrix; score 5.90; seq TWLGLLSFQNLHC/FP
atcattttcttatccctgctgatttcaaaccttcccatggtttagaagcataacctgtaatgtaatgcaagtcccctaactccctggttgctaacattaacttccttaagtaataatcaatgaaagavattctatgcatggttttgaaataatatccttgaaagaggaatcaccattaggaaaggtgagtcagggtcctttgtttaatgtgactagtggctcatcatcaccagtgacctggttgggcctactctccttccagaacctgcattgcttcccagacctccccggg

SEQ ID NO: 732 - DNA, 458 bp, Homo Sapiens
  Cancerous prostate
  sig_peptide 270..437: Von Heijne matrix
  score 5.90
  seq NTLFLHLSGLSAA/DT
  misc_feature 254: n=a, g, c or t
aagctctgagacaggagcccagccctgggattttcaggtgttttcatttggtggtcaggcctgaacagagtgttttcctttggtggtcaggactgagcagagagacctcaccatggagcttkggsygktgckggctttttcttgtggccattttgaaagatgtccggtctgagggacaactattggaatctgggggaagttcggtccagcccggggagtccctgcgactctcctgtgcagccgctggattcgcntttcgcaattttgccatgacttgggtccgccacgctccagggaagagtctggaatgggtcgcaaccgtcacagatggtggtgataagaccttttatgcggcctccgtgaagggccgcttcaacgtctccagggacaattccaagaacacgttatttctgcatttgagcggcctgagtgccgccgacacgggctggtgggggatc

SEQ ID NO: 733 - DNA, 226 bp, Homo Sapiens
  Prostate
  sig_peptide 143..184: Von Heijne matrix; score 5.80; seq LTSFFSLTANCQS/AG
aacatacccttcaggtttaggtctttcttaggtaaagttttaactttagtatatcttcctcagggcggccttctccttccccctagtaagtgragaaacccttgtgtktctgccctctgaactcaccgcatttgggattaccatgctaacatcctttttttcactgactgcaaattgccagagtgcaggaactatctcatttgctgctttctccctaatgcctgga

SEQ ID NO: 734 - DNA, 140 bp, Homo Sapiens
  Cancerous prostate
  sig_peptide 72..125: Von Heijne matrix
  score 5.80
  unsure -6: seq LTPLFFMXPTGFS/SP; position -6 of amino acid sequence; Xaa = Phe,Leu
acttcccttccccctctagcattgctaccttctctcctacacgcacgcaggcatataaacgtaggtttttgatgctcctctgcctgttgaccccgctatttttcatgttkccaacaggtttttcttcccccagtcctggg

SEQ ID NO: 735 - DNA, 288 bp, Homo Sapiens
  Cancerous prostate
  sig_peptide 178..240: Von Heijne matrix; score 5.70; seq HSLFLSLLGLCPS/KT
aattggcgcggggcgtccgtagccacggcaacaggttgcttctgcagtctgagctgagcgcctttcgcacgacttggagttacggtttatttgataccccggtacccctacgcaagcaagcccacatcgacacacattcacacacgcccttcagcaccccctcccagcaccacgaccatggacgacgactatgaagcgtaccacagtctgttcttgtcgctgctcggactctgcccgtctaagactcccatcaatgaaaatgctcccgtctttgatcctgaaccggtc

SEQ ID NO: 736 - DNA, 393 bp, Homo Sapiens
  Hypertrophic prostate
  sig_peptide 298..354: Von Heijne matrix; score 5.70; seq WLVWLLLGHMVVS/QM
ctcttgcctcaggcttggaggcctccgagcagcaacatcgtcccaattataccccgttggagcatcttcagatcttccactcttttcacaacgcaatcaaaatcttcgtacccattttgcagtagtgatctctaaactctcagcgtaggcatcgggaaccttcgtgccaaggagccatgctgccccgatgggaactggcactttacctacttgcctcactaggcttccacttctattccttctattaagtttacaaagtctccagaggatgcgaccgactttgagtggagcttctggatggaatgggggaagcagtggctggtgtggcttctccttggccacatggtagtgtctcaaatggccacactgctggcaagaaagcacagaccctgg

SEQ ID NO: 737 - DNA, 281 bp, Homo Sapiens
  Prostate
  sig_peptide 135..251: Von Heijne matrix; score 5.70; seq LTQGVLWILVIQA/VP
atatacagagaataaacgtcatccctctaacattaatatgttcagttttatgtacctgagagttgatggtttaatttgtgggtttgcccagactctcttgcgacttctctcatcatctgctctttagcacttccatgagacggggcaagagattgttggagtctcaatccagcagcccgaaagcctgtctgcagcttgggtttgagactgaactaactcagggtgttttgtggattttagttatccaggctgtccctgttccctcattaacaaaaacaaaa

SEQ ID NO: 738 - DNA, 276 bp, Homo Sapiens
  Normal prostate
  sig_peptide 205..264: Von Heijne matrix; score 5.70; seq ALLESVVWLPCHG/RG
agaccaggcccatttctcagaagcctttggctcccctgagatgccaaatagccgctcactcttccgcctccacggactggctttggtgttcatgctggttgggatgtctactatggacctgctgagcacagggctgggttcctggggcacagagttgatgcttatggcccaggaactgctgggccccaggactgggcggtttccatggttgctgccacagaagcagcattgctggagtcagtagtgtggctgccttgccatggccgtggtgggtct

SEQ ID NO: 739 - DNA, 421 bp, Homo Sapiens
  Normal prostate
  sig_peptide 356..412: Von Heijne matrix; score 5.60; seq VSLPLLSSWGSTA/WT
aattacagctctacaatgcaccagacggacccatctggattctttcggggctcttagccctagaaatagcatcatttcttcaaactggtgagtcctcctgtctaaaatcaggatgcagagagttgatgcacggcatggcacaggatgctgggcaaggctggcaggcccgggagagcctgtggccagcctgggtccaggaagtgggcagctgccacagaggggcctccgaggctagctgcctcctaacttcctcacggcacaccattctgccgtcctgagtcttctcaaggttggaaggtgcccagatccagggagatggtgctggctctttggtggctgtggagtgtccagacagatgagctggaatccttcagtttctctgcctctcctgtcaagttggggtagcactgcttggactctt

SEQ ID NO: 740 - DNA, 193 bp, Homo Sapiens
  Prostate
  sig_peptide 53..118: Von Heijne matrix; score 5.60; seq LILLSLHLERRWT/SP
acaataataactaatgagattaaaatttaaaacaggtgtctgataatccttgatgaagagaattcaggggatattgttcctgattttgctttctctccacttggaaaggaggtggacgagcccatcagaccacagcctgttgctaggaggaaattccttggctcaacatgcagaaagtgtagtacgccaaggg

SEQ ID NO: 741 - DNA, 435 bp, Homo Sapiens
  Normal prostate
  sig_peptide 298..402: Von Heijne matrix
  score 5.50
  unsure -17: seq LLTFGLEVCLAAG/SP
  position -17 of amino acid sequence
  unsure -15: Xaa = Gly,Leu,Val,Trp; position -15 of amino acid sequence; Xaa = Gly,Val
aaaggaagggggggcggaaccagcctgcacgcgctggctccgggtgacagccgcgcgcctcggccaggatctgagtgatgagacgtgtccccactgaggtgccccacagcagcaggtgttgagcatgggctgagaagctggaccggcaccaaagggctggcagaaatdvgcgcctggctgattcctaggcagttggcrgcagcaaggaggagaggccgcagcttctggagcagagccgagacgaagcagttctggagtgcctgaacggccccctgagccctacccgcctggcccactatggtccagaggctgtgggtgagccgcctgctgcggcaccggaaagcccagctckkgctggkcaacctgctaacctttggcctggaggtgtgtttggccgcaggatcacctatgtgccgcctctgctgctggaagtgg

SEQ ID NO: 742 - DNA, 392 bp, Homo Sapiens
  Cancerous prostate
  sig_peptide 27..80: Von Heijne matrix
  score 5.50
  unsure 68: seq PFALVTSCSSVFS/GD
  position 68 of amino acid sequence
  unsure 71: Xaa = Cys,Phe,Gly,Ile,Ser,Val; position 71 of amino acid sequence; Xaa = Glu,Lys
agacggaaccagctcgcgagcgcactatggctgctggcgtaccctttgcgttagtcaccagctgctcctccgtcttctcaggagaccagctggtccaacatatccttggaacagaagatcttattgtggaagtgacttctaatgatgctgtgagattttatccctggaccattgataataaatactattcagcagacatcaatctatgtgtggtgccwaacaaatttcttgttactgcagagattgcagaatctgtccaagcatttgtggtttactttgacdkcacacaaraatcgggccttgatagtgtctcctcatggcttccactggcaaaagcatggttacctgaggtgatgatcttggtctgcgatagagtgtctgaagatggtata

SEQ ID NO: 743 - DNA, 358 bp, Homo Sapiens
  Prostate
  sig_peptide 290..331: Von Heijne matrix
  score 5.50
  seq TVFLXFCFPRCHS/DS
  misc_feature 150,307: n=a, g, c or t
  unsure -9: position -9 of amino acid sequence
  unsure 4: Xaa =  * ,Ser,Tyr
  position 4 of amino acid sequence
  unsure 5: Xaa = Lys,Arg; position 5 of amino acid sequence; Xaa = Met,Val
aatgctgaacggwcacacagagaggaaacwataaatkkyagctactatgcaataaatatctcaagttttaacgaagaaaaacatcattgcagtgaaataaaaaattttaaaattttagaacaaagctaacaaatggctagttttctatgnttcttcttcaaacgctttctttgagggrgmaagagtcamacaaacaagcagttttacctaaaataaagaactagttttagaggtcagamgamaggmgcaagttttgcgagwggcacggaaggagtgtgctggcagtacaatgacagttttcctttmnttttgctttcctcgctgccattctgactcacatargrtgcagcaatcagcg

SEQ ID NO: 744 - DNA, 310 bp, Homo Sapiens
  Hypertrophic prostate
  sig_peptide 44..187: Von Heijne matrix
  score 5.40
  unsure -47: seq ILLEVFVWNGLQG/LP; position -47 of amino acid sequence; Xaa = Phe,Val
aasttcttcctgccaagagaacaatgccgagaaacagagcgaaatgkttccaaataatttttggcaaaaacttggaagaaaaaaaccccgcatatttacctgtacccagagctccacaggtgaggcggcagttaaagcagaaaatctaattcttctggaagtttttgtctggaacggactccagggtcttccttcggagctgtcagatacaagtggatcctctaagaaacttgggagccttgtgggctggtggagaactctcaagatggcaccagcctgtctatggtctatgtgggaatcaccgccacgg

SEQ ID NO: 745 - DNA, 284 bp, Homo Sapiens
  Cancerous prostate
  sig_peptide 66..173: Von Heijne matrix
  score 5.30
  unsure -28: seq ALYIMCVPHSVWG/CA; position -28 of amino acid sequence; Xaa = Asn,Ser
aagtccagaggcctggccctgccaagaaggcgctctccggaatcaacacctgggggcttggaaggatgtttcgctcagatcgaatgtggarctgccattggaaatggaagcccagtcctctcctgttcttatttgctttatatatcatgtgtgttcctcactcagtgtggggatgtgccaactgccgagtggttttgtccaacccttctgggacctttacttctccatgctaccctaacgactacccaaacagccaggcttgcatgtggacgctccgagacccc

SEQ ID NO: 746 - DNA, 398 bp, Homo Sapiens
  Normal prostate
  sig_peptide 123..215: Von Heijne matrix; score 5.30; seq LVALSSELPFLGA/GV
tccttcatcttgtgttctaaaaccttgcaagttcaggaagaaaccatctgcatccatattgaaaacctgacacaatgtatgcagcaggctcagtgtgagtgaactggaggcttctctacaacatgacccaaaggagcattgcaggtcctatttgcaacctgaagtttgtgactctcctggttgccttaagttcagaactcccattcctgggagctggagtacagcttcaagacaatgggtataatggattgctcattgcaattaatcctcaggtacctgagaatcagaacctcatctcaaacattaaggaaatgataactgaagcttcattttacctatttaatgctaccaagagaagagtatttttcagaaatataaagattttaatacctgcccag

SEQ ID NO: 747 - DNA, 324 bp, Homo Sapiens
  Prostate
  sig_peptide 187..228: Von Heijne matrix; score 5.30; seq IIPLLLLLRSACN/VH
actccaggagccgggaccaaaataaccgggcgggaggggacacctcgcagagatggatctcgaactcctgggctcaagcgatcctttcaccttggcctctcaagtagctgggaccacatttgctcaccagctggcccaagaccagactgggcaacatgggtcatcctcctctaagattccaggaccatgatcatccctctattgctacttcttagatcagcttgtaatgtccatctcccccaccagactgcgtctccagcatctctgagtccccagggcctggcctggggcttgctacatggtgggtgctcagtaactgtgaga

SEQ ID NO: 748 - DNA, 293 bp, Homo Sapiens
  Hypertrophic prostate
  sig_peptide 231..287: Von Heijne matrix
  score 5.30
  seq VLLLSXNLNLIIQ/SS
  misc_feature 143,150: n=a, g, c or t
  unsure -18: position -18 of amino acid sequence
  unsure -8: Xaa =  * ,Ser,Tyr; position -8 of amino acid sequence; Xaa = Cys,Phe
actatggagggaagacacagggaaaggagtatttcaaaaactttaaataattgtacataattggagcaagtgagaagacaagtkagaggtaagcwgktrttgagaataggggkctgattgtgccagctttgtatacvattatnaggaacndggactttgtcctgaaggtaactgggcaattgttgaggtcaccaccatctactgtctggattaccgaggaaactttctaaatgtmstctccacttccagtcctgctcctctcatkcaatctcaacctaataattcagagtagt

SEQ ID NO: 749 - DNA, 402 bp, Homo Sapiens
  Normal prostate
  sig_peptide 244..381: Von Heijne matrix
  score 5.20
  unsure -30: seq LLTFLVFTXKLSS/LN
  position -30 of amino acid sequence
  unsure -29: Xaa = Ile,Met
  position -29 of amino acid sequence
  unsure -5: Xaa = Lys,Arg
  position -5 of amino acid sequence
  unsure 4: Xaa = Glu,Gly; position 4 of amino acid sequence; Xaa = Gly,Arg
acactgaaatcaatctgttcaatagcattataccatatttgacataccatagccatgttaatctgatattgtagaatagcatagtakaataataataactcctaactcaaggatgttgwgwkcctttataaccagcaatccatgttaratattagcacagtgcctaaaacatattaagcattcaataaatgatcgctactatttttactaacatcctacagatttggaaattgagtcttagaaatgttaatgtgtaaaatgctaaagagccaaaaaaactgccaggaaaatatraraattaaaatcattttatttctgaaacccatgtgttccccccaatatcttctaacatttctagtatttacagraaaactttcaagtctcaatatcrgaaagtttcat

SEQ ID NO: 750 - DNA, 470 bp, Homo Sapiens
  Cancerous prostate
  sig_peptide 306..461: Von Heijne matrix
  score 5.20
  seq IIVILHCAASIIS/CP
  misc_feature 362: n=a, g, c or t
  unsure -36: position -36 of amino acid sequence; Xaa =  * ,Cys,Trp,Tyr
aagtattaaatttaaaaagataaatctgccctattctaatcatgtctttgtcttctgtttattcaagtgtattccatttgctttcgggaatatttggatgttttagaactaacattctgctttaataatccaaacacrckaymaktyccatcaatttgagtctcttaaaatgttacactgaaatgaatctctctgaagatggacttattgatttctatattcttcctctagcatcatgaaatttgacctcttcagccgtgcatggttaacactcagataacccatctccttgagaagaacccctgatgaaraagaaatcctctccaaatcaatatcttcattcatcactacactrsatacgnctattttccttcctccatttctcagaggaaggagttctattacttgccattgatcttaaaattatagttatcctccactgtgctgcatccataatttcatgtccctca

SEQ ID NO: 751 - DNA, 334 bp, Homo Sapiens
  Prostate
  sig_peptide 116..184: Von Heijne matrix; score 5.10; seq ATSVSLEAQSCFA/WP
atttttgaaaactgtaatgctttaaaacttactttattggatctctttgcagcttttgacacagtgaaccactttcctttcctgaaatgctttcctctcttggctttctgatgccatgttctcctgtttcttctctacttctctggccacttctgtctccttagaagctcagtcttgctttgcctggcccttgattgttagttttccccagggctcacttcttagcccctttctcctcatgtcttataatttgagtcatctcatctactctggggagttgaatggtcgcttgtatgctgaaaactcccaaatttgtatctgtagcccagccggg

SEQ ID NO: 752 - DNA, 302 bp, Homo Sapiens
  Normal prostate
  sig_peptide 78..227: Von Heijne matrix; score 5.10; seq RTALILAVCCGSA/SI
agtttccaagggaaggagcagcgtgtgggaaagcacagaagagtgagaaggaagcgactaaattttatttactttctatgcatcatggcctcacaccactgttacttggtgtacatgagcaaaaacagcaagtggtgaaatttttaatcaagaaaaaagcaaatttaaatgcactggatagatatggaagaactgctctcatacttgctgtatgttgtggatcggcaagtatagtcagccttctacttgagcaaaacattgatgtatcttctcaagatctatctggacagacggcccccggg

SEQ ID NO: 753 - DNA, 381 bp, Homo Sapiens
  Normal prostate
  sig_peptide 319..369: Von Heijne matrix; score 5.10; seq IYFFACFQALTSS/SP
agagtaggcggagacagagaggctgtatttcagtgcagcctgccagacctcttctggaggaagactggacaaagggggtcacacattccttccatacggttgagcctctacctgcctggtgctggtcacagttcagcttcttcatgatggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcaggcattgacatcctcatctccacctcag

SEQ ID NO: 754 - DNA, 318 bp, Homo Sapiens
  Hypertrophic prostate
  sig_peptide 49..141: Von Heijne matrix
  score 5.10
  unsure -20: seq VSGASGFLPPARS/RI
  position -20 of amino acid sequence
  unsure 11: Xaa = Arg,Ser; position 11 of amino acid sequence; Xaa = Ala,Gly,Ile,Leu,Pro,Arg,Ser,Thr,Val
ctttctgtgtctcctttcctccgcctcagtttggggcgggtcgggggaatggctgaggagatggagtcgtcgctcgaggcaagsttttcgtccagcggggcagtgtcaggggcctcagggtttttgcctcctgcccgctcccgcatcttcaagataatcgtgatcggcgacvbcaatgtgggcaagacatgcctgacctaccgcttctgcgctggccgcttccccgaccgcaccgaggccacgataggggtggatttccgagaacgagcggtggagattgatggggagcgcatcaagatccagctatgggacacagca

SEQ ID NO: 755 - DNA, 243 bp, Homo Sapiens
  Hypertrophic prostate
  sig_peptide 61..153: Von Heijne matrix
  score 5.10
  unsure 14: seq VSGASGFLPPARS/RI; position 14 of amino acid sequence; Xaa = Gly,Arg,Ser
aaatctctcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtdvgcaagacatgcctgacctaccgcttctgcgctggccgcttccccgaccgg

SEQ ID NO: 756 - DNA, 278 bp, Homo Sapiens
  Normal prostate
  sig_peptide 153..233: Von Heijne matrix; score 5.00; seq HLSLILLKPLCLP/NN
accttttataaacattttgtttaacttttattgtggtaaaatacacataacacttctcttcttttagacctgggctggtaagaagtgctgaagatgttttttagagatttgtggtatgacaaattccactggggtttctgascttctcagtcatgcttgtcttggggtcaccactccttggccctctcctatggcacctgtccctcattctgctcaagcccctatgccttcccaacaacttgcctttagctctgggcagatgtctttgcttgcactcg

SEQ ID NO: 757 - DNA, 301 bp, Homo Sapiens
  Cancerous prostate
  sig_peptide 56..220: Von Heijne matrix; score 5.00; seq VLFMTTAVDLVIT/EV
agaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccgcg

SEQ ID NO: 758 - DNA, 129 bp, Homo Sapiens
  Normal prostate
  sig_peptide 1..63: Von Heijne matrix
  score 4.80
  unsure 10: seq VLFVFSSIPLTFL/FQ; position 10 of amino acid sequence; Xaa =  * ,Gly
atggagaatttgaaagacttttatgtgttgtttgtattctctagcattccccttacatttctatttcagaaattgccttttgtttggattkgagaagagactttggagacatggtatttgaagagctgg

SEQ ID NO: 759 - DNA, 352 bp, Homo Sapiens
  Cancerous prostate
  sig_peptide 293..346: Von Heijne matrix; score 4.80; seq LSIFSLVLPVCRM/HR
acaattccagcttatgtgtcccttttataaacttgtgatacattttaactgtgtatacacatctcttgcctctattggtagagagtatctgscakgcctagcatgtgctggatgtcatatcagatactcagtgttatttattgggcttacagtgataaccaaagctcacatgttttagcactcccacttccataaagtggaagatgtcccctctgcctcttctctcatccctcctcaaagcagcaggagtgacttacctgattgaccagtttaagactatatctgagcaggcatgccacagtactgtctcagcatcttctctcttgtgctgcctgtctgcaggatgcacagg

SEQ ID NO: 760 - DNA, 194 bp, Homo Sapiens
  Normal prostate
  sig_peptide 15..143: Von Heijne matrix; score 4.80; seq LLAFGTSCSVVLY/DP
gaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgggttgttgttaccaacttgaatggtcacaccgcccgttccgg

SEQ ID NO: 761 - DNA, 346 bp, Homo Sapiens
  Hypertrophic prostate
  sig_peptide 134..247: Von Heijne matrix
  score 4.80
  unsure -3: seq LSWLITWFGHXLS/DF; position -3 of amino acid sequence; Xaa = Asp,Glu,Val
attgtggtcacatttctgctggtggtaggcgagaggctggcaacatccctggtagaaaaattatctacccaccacctcagggattttatggatccavcaatggracaacaccamgcatatattaaactatctgatgcccatcattgaccaggtgaatccagagctccatgacttcatgcagagtgctgaggtagggaccatctttgccctcagctggctcatcacctggtttgggcatgwmctgtctgacttcaggcacgtcgtgcggttatatgacttcttcctrgcctgccacccactgatgccgatttactttgcagccgtgattgtgttgtatcgcgagcag

SEQ ID NO: 762 - DNA, 374 bp, Homo Sapiens
  Cancerous prostate
  sig_peptide 63..209: Von Heijne matrix
  score 4.70
  seq GLCVLVPCSXSXX/WR
  misc_feature 107: n=a, g, c or t
  unsure -46,-4: position -46, -4 of amino acid sequence
  unsure -37: Xaa = Cys,Phe
  position -37 of amino acid sequence
  unsure -35: Xaa = Cys,Gly
  position -35 of amino acid sequence
  unsure -31,41: Xaa = Asp,Glu,Gly,Val
  position -31, 41 of amino acid sequence
  unsure -30: Xaa = His,Gln
  position -30 of amino acid sequence
  unsure -2: Xaa = Asp,Glu
  position -2 of amino acid sequence
  unsure -1: Xaa =  * ,Tyr
  position -1 of amino acid sequence
  unsure 36: Xaa = Ala,Pro
  position 36 of amino acid sequence
  unsure 38: Xaa = Leu,Val
  position 38 of amino acid sequence
  unsure 39: Xaa = Ala,Asp,Glu,His,Pro,Gln
  position 39 of amino acid sequence
  unsure 40: Xaa =  * ,Asp,Glu,Tyr
  position 40 of amino acid sequence
  unsure 42: Xaa = Ile,Thr; position 42 of amino acid sequence; Xaa = Gly,Trp
aaktkkkkggagcatttccttccctgacagccggacctggkactgggctggggccctggcggatggagacatkctgcccctgctgctgctgcccctgckgtggggdngggtccctgcakgakaagccagtktacgagctgcaagtgcagaagtcggtgacggtgcaggagggcctgtgcgtccttgtgccctgctcctkctcttasscctggagatcctggtattcctctcccccactctacgtctactggttccgggacggggagatcccatactacgctgaggttgtggccacaaacaacccagacagaagaktgaagsmdkakayycakkggccgattccgcctccttggggatgtccagaagaagaactg

SEQ ID NO: 763 - DNA, 399 bp, Homo Sapiens
  Cancerous prostate
  sig_peptide 295..345: Von Heijne matrix
  score 4.70
  seq IYFFACFXXLTSS/SP
  misc_feature 330..332: n=a, g, c or t
  unsure -6: position -6 of amino acid sequence
  unsure -5: Xaa = His,Gln; position -5 of amino acid sequence; Xaa =  * ,Ala,Glu,Gly,Ile,Lys,Leu,Pro,Gln,Arg,Ser,Thr,Val
attttcagtgcagcctgccagacctcttctggaggaagactggacaaagggggtcacacattccttccatacggttgagcctctacctgcctggtgctggtcacagttcagcttcttcatgrwkggtggatcccaatggcaatgaatccagtgctacatacttcatcctaataggcctccctggtttagaagaggctcagttctggttggccttcccattgtgctccctctaccttattgctgtgctaggtaacttgacaatcatctacattgtgcggactgagcacagcctgcatgagcccatgtatatatttctttgcatgctttcannnattgacatcctcatctccacctcatccatgcccaaaatgctggccatcttctggttcaattccacta

SEQ ID NO: 764 - DNA, 110 bp, Homo Sapiens
  Normal prostate
  sig_peptide 12..92: Von Heijne matrix
  score 4.70
  unsure -5: seq VLKCLSFSXPSLP/GF; position -5 of amino acid sequence; Xaa = Ala,Pro
aagcaaccgggatgggacggggagagaggaggcactactggggacctaagctggttctcaaatgcctctccttttcssctccaagcctcccaggcttcctatggtcccta

SEQ ID NO: 765 - DNA, 251 bp, Homo Sapiens
  Cancerous prostate
  sig_peptide 9..164: Von Heijne matrix
  score 4.70
  unsure -46: seq LLAKALHLLKSSC/AP; position -46 of amino acid sequence; Xaa = Leu,Val
agcctgcgatgtctcaagatggcggastgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctccctaaag

SEQ ID NO: 766 - DNA, 272 bp, Homo Sapiens
  Normal prostate
  sig_peptide 18..224: Von Heijne matrix
  score 4.60
  unsure 7: seq LGPSLSSLPSALS/LM; position 7 of amino acid sequence; Xaa = Phe,Ile,Val
tatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtdttggggatcgaggggtgatgtgtgggtta

SEQ ID NO: 767 - DNA, 127 bp, Homo Sapiens
  Cancerous prostate
  sig_peptide 62..118: Von Heijne matrix; score 4.60; seq IWNLFSLFSTSTT/LP
acatccttgattctttactttctcttaacaccctgtatccagctggtcataaatctagcagatgctacattcagataacatctggaatctattttccctattttctacttctactaccctgccccgg

SEQ ID NO: 768 - DNA, 135 bp, Homo Sapiens
  Normal prostate
  sig_peptide 4..75: Von Heijne matrix; score 4.60; seq FHSAAGWSGGGQA/CG
attatgcaacccgcctccccgcccgcccggtggagcttccactcggctgcgggctggagcggcggcgggcaggcgtgcggaggacactcctgcgaccaggtactggctgtgatcgaacttctcaaccctctcagg

SEQ ID NO: 769 - DNA, 233 bp, Homo Sapiens
  Cancerous prostate
  sig_peptide 138..191: Von Heijne matrix; score 4.50; seq LLAGSISHMFSQA/LP
atattttgccttagcagcctgggcttcggaactgggcttgccctgtagcaggtcacttgcacctttctgccacagatgacggaaacatttaaagttatggattgtgtctctgcatcctcttcccttcacaccagccaatgtgtttttcatttctcttggctggctcaatttcccacatgttctcccaagctcttcctctccactccccagggcttcccaccacaaaccgcacg

SEQ ID NO: 770 - DNA, 214 bp, Homo Sapiens
  Prostate
  sig_peptide 137..199: Von Heijne matrix; score 4.50; seq SILFHCSVCLFLC/QY
atatggcaagagatagagatctagtttcattcttctgcatatggatatccaattttcccagcaccatttattgaagagacagtccttttgccagtktatgttcttggcaactttgttgaaaatgcatttactgtagatgtatggattcattattgggttatctattctgttccattgttctgtgtgtctgtttttatgccagtaccatgcctgg

SEQ ID NO: 771 - DNA, 231 bp, Homo Sapiens
  Normal prostate
  sig_peptide 139..210: Von Heijne matrix
  score 4.50
  seq SLLGCXLAININT/FP
  misc_feature 188: n=a, g, c or t
  unsure -20: position -20 of amino acid sequence
  unsure -8: Xaa = Cys,Gly; position -8 of amino acid sequence; Xaa = His,Leu,Pro,Arg
atcctattgtgtcgtgtagcttgttctctattttataggtcatttaaaataaaactcacctttgactttgtttagtctctgttacatgtttgctttttgtttcgtttatgtttgtacatttctcatgtktttctkkctatgtcttttggtkgtattctaacttttagagtctctttattgggatgtcntctagcgataaatataaatacatttccctctaacaaccacttg

SEQ ID NO: 772 - DNA, 269 bp, Homo Sapiens
  Prostate
  sig_peptide 12..77: Von Heijne matrix
  score 4.40
  unsure -2: seq LGRLCAGSSGVXG/AR
  position -2 of amino acid sequence
  unsure 4: Xaa = Leu,Val; position 4 of amino acid sequence; Xaa = Ala,Gly
aaaagcgagccatggctgtctacgtcgggatgctgcgcctggggaggctgtgcgccgggagctcgggggtgstgggggcccgggccgscctctctcggagttggcaggaagccaggttgcagggtgtccgcttcctcagttccagagaggtggatcgcatggtctccacgcccatcggaggcctcagctacgttcaggggtgcaccaaaaagcatcttaacagcaagactgtgggccagtgcctggagaccacagcacagagggtcccg

SEQ ID NO: 773 - DNA, 276 bp, Homo Sapiens
  Hypertrophic prostate
  sig_peptide 187..255: Von Heijne matrix; score 4.40; seq LVSIFFFWEVTNA/FL
agataattttgatgaaaccaagaggcacgtctttctacatacttctcttcatckycmwttcctagtgttttwgtttatkttttttaaataatgcccatgtctcctgctgtcattctctgagaccaccaaatagtttaatacctggagtcagagataagaataaacaggcttaagatactttaaataatgttcaatactatatacttggtcatatcattagtgagcatatttttcttttgggaagtaactaatgctttccttaaggccaggcgttgg

SEQ ID NO: 774 - DNA, 137 bp, Homo Sapiens
  Normal prostate
  sig_peptide 36..101: Von Heijne matrix; score 4.40; seq SLPLTTGSSWSLS/SQ
accttctcaagaactgtgttcacccacttccccacatggcccttccacccaagggatgtggtagtctccctttgactactgggtcttcctggagcctttcttctcaaataggaagccctgctatttccaaccctagg

SEQ ID NO: 775 - DNA, 127 bp, Homo Sapiens
  Hypertrophic prostate
  sig_peptide 44..91: Von Heijne matrix; score 4.30; seq FLSWASFLAPLLR/SP
gtcatttgtccgtttcttcccccttgccaattttttaattagaatgtttgtctttttgtcttgggcaagtttcttagcccctctactgaggagcccatttcttcattgtctaatggggatgccaggg

SEQ ID NO: 776 - DNA, 302 bp, Homo Sapiens
  Normal prostate
  sig_peptide 150..233: Von Heijne matrix
  score 4.30
  seq LLSCSPLXPLGKS/GF
  misc_feature 291: n=a, g, c or t
  unsure -27: position -27 of amino acid sequence
  unsure -16: Xaa = Ile,Lys
  position -16 of amino acid sequence
  unsure -6: Xaa = Asn,Ser
  position -6 of amino acid sequence
  unsure 18: Xaa =  * ,Cys
  position 18 of amino acid sequence
  unsure 20: Xaa = Ile,Met; position 20 of amino acid sequence; Xaa = Ala,Pro,Ser,Thr
aakagtcagcaggagtkagttcaggaatcctcgggacaaggcactttcctgagcactggaccagcgacctcttggcttccagggaggacacacagccatcatggwacccathtctcagaagagtccaggcaaacagtttacattttcttatgawaatgaagtctgcaaacaagattactttattaartcaccaccttctcagctgttctcctctgtgwcctcttggaaaaagcggtttttcatcctgtcaaaggctggggaaaagagctttagtctttcctattatraagnccatcatcacc

SEQ ID NO: 777 - DNA, 251 bp, Homo Sapiens
  Cancerous prostate
  sig_peptide 150..245: Von Heijne matrix; score 4.20; seq SFLLLFIVIPQTP/RP
aatttgataacatcagctaatatttttcaaagttagatttttgaggtataatttacataagagttactctttctagaggtatagttgaatgcattttcacaaatgtgtacaattggataaccaccamcatwawtctagawatataggtaatgtgtaattataatatatatgtactatataatataggatatttataccacccaaaaagttttctcttgctttttatagtcattccccaaaccccacgtccg

SEQ ID NO: 778 - DNA, 383 bp, Homo Sapiens
  Normal prostate
  sig_peptide 84..164: Von Heijne matrix
  score 4.20
  unsure 2: seq PLLAAPLLRSLLP/RX
  position 2 of amino acid sequence
  unsure 34: Xaa = Ala,Glu
  position 34 of amino acid sequence
  unsure 43: Xaa = Gly,Arg
  position 43 of amino acid sequence
  unsure 45: Xaa = Gly,Ser
  position 45 of amino acid sequence
  unsure 53: Xaa = Lys,Arg
  position 53 of amino acid sequence
  unsure 64: Xaa = Cys,Gly,Ser; position 64 of amino acid sequence; Xaa = Leu,Met
aactgaacagcggascggacggggatcgccggcgggcggcaagcggaggcggcccagrgcccggcggtctccgagatgtcacgatggctgtggccatggtcaaactgtgtgaaagagcgggtctgccgctacttgctgcaccactacttaggtcacttcttccaagagmacctcagcctggaccagctcagcctcgatctgtacaagggcagcgttgccctgcgagacatccacctggaaatctggtctgtgaacgaggtgctrgagtcaatggagtcaccgctggagctrgtggaargcttcgtgggctccatcgaggtdgccgtgccctgggctgctctgctcaccgaccamtgcacagtgcgcgtgtccggcctccagct

SEQ ID NO: 779 - DNA, 479 bp, Homo Sapiens
  Cancerous prostate
  sig_peptide 99..464: Von Heijne matrix
  score 4.20
  unsure -113: seq DVLLGLLKDVLLA/RP; position -113 of amino acid sequence; Xaa = Phe,Val
taaacttctgaaagaaagagaagatcttcctatatggaaagaaaaatactcctttatggagaacctgcttcaaaatcaaatcgtgattgtttcaggagatgctaaatgtggtaagagcgctcaggktycctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggtattgtactgatgatatgctgcaaagagaaatgatgtccaatccttttttgggtagctatggggtcatcatcttagatgatattcatgaaagaagcattgcaactgatgtgttacttggacttcttaaagatgttttactagcaagaccagaactgaag

SEQ ID NO: 780 - DNA, 208 bp, Homo Sapiens
  Normal prostate
  sig_peptide 107..187: Von Heijne matrix
  score 4.20
  unsure -20: seq AGLCIGSTSYVHG/DI
  position -20 of amino acid sequence
  unsure -18: Xaa = Asp,Glu,Lys,Asn; position -18 of amino acid sequence; Xaa = Ile,Asn
attgggagcagcagcatctacttcacagaccagtgtccagttaattgtgtttgtggcaatcatcctacataaggcaccagctgcttttggactggtttccttcttgatgcatgctggcttagagcggrawtcgawtcagaaagcacttgctggtctttgcattggcagcaccagttatgtccatggtgacatacttaggactgagcgg

SEQ ID NO: 781 - DNA, 285 bp, Homo Sapiens
  Prostate
  sig_peptide 151..255: Von Heijne matrix; score 4.20; seq LLGSLSLWRWSAM/EP
aattgctgggctcgaagcacaggagagaccagtccttccttgtctccactgggctgtktagtgcttctttcccaaggacktccatcccttccccaggctttatggttccagtkcttctaccattctggaagctccctagaatctcctggaatgcttaatggacctttccagcaccgaaattcaagaattatgactcatcggtcagcagaaaagaccctgctgggatctttgagcttgtggaggtggtcggcaatggaacctacggacaggtgtacaagggtaggg

SEQ ID NO: 782 - DNA, 409 bp, Homo Sapiens
  Cancerous prostate
  sig_peptide 44..175: Von Heijne matrix; score 4.10; seq IAVGLTCQHVSHA/IS
aaggttgtagacgctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagccccattgtattataattaatctgagcaca

SEQ ID NO: 783 - DNA, 279 bp, Homo Sapiens
  Cancerous prostate
  sig_peptide 184..267: Von Heijne matrix; score 4.00; seq FSLLALSMLKGTG/KV
acataatcggcctttatgttacactgcctggccagcccctgttattctagtgcataattgatggtgctcacaagtggaaaagttagaaaagcggaagtaatgtgacgcagcagtgccatgragcssccggdvccccggcagtgagggcaatgcagagatgggctgctgctggctaccgccaggatgcctcagaagggcctgggcttacttggcatcttgtcaggagacttttcccttcttgctttgtccatgctgaaagggacaggaaaggtaggcggg

SEQ ID NO: 784 - DNA, 326 bp, Homo Sapiens
  Normal prostate
  sig_peptide 69..233: Von Heijne matrix
  score 4.00
  seq AALCGISLSQLFP/EP
  misc_feature 97: n=a, g, c or t
  unsure -48: position -48 of amino acid sequence
  unsure -47: Xaa = Cys,Trp
  position -47 of amino acid sequence
  unsure -46: Xaa =  * ,Glu,Gln
  position -46 of amino acid sequence
  unsure -39: Xaa = Lys,Met,Arg,Thr
  position -39 of amino acid sequence
  unsure -23: Xaa = Leu,Val
  position -23 of amino acid sequence
  unsure -22: Xaa = Asp,Glu
  position -22 of amino acid sequence
  unsure 17: Xaa = Ala,Leu,Pro,Ser,Val; position 17 of amino acid sequence; Xaa = Gly,Leu,Arg,Val
aagaacctgagcagcctgtcttcagacagagagaggcccacggctgtttcttgaaaytggcgctgggaatggccatgtggaacaggccatgbbagangctgcctcagcagcctctsstagctgagcccactgcagagggggagccacacctgcccacgggccgggasbygactgaggccaaccgcttcgcctatgctgccctctgtggcatctccctgtcccagttatttcctgaacccgaacacagctccttctgcacagagttcatggcaggcctggtgskmtggctggagttgtctgaagctgtcttgccaaccatgactgct

SEQ ID NO: 785 - DNA, 194 bp, Homo Sapiens
  Normal prostate
  sig_peptide 126..182: Von Heijne matrix; score 4.00; seq LLLSPWVTVPVWS/SS
cctagtgcttaagggcatttagcatcatccaagcagggtaaacttttgttttgttaaaagaaaaatgtgttattcaagttggtgtccccagttgtagctaacacatctggaatgcactaaccaaaatgctgtgctttggagacctgcttttgtcaccgtgggtaaccgttcccgtctggtccagtagcccgtgg

SEQ ID NO: 786 - DNA, 170 bp, Homo Sapiens
  Normal prostate
  sig_peptide 27..107: Von Heijne matrix
  score 4.00
  unsure 14: seq LIYFLGLAADTYF/RS
  position 14 of amino acid sequence
  unsure 15: Xaa = Gly,Leu,Val,Trp
  position 15 of amino acid sequence
  unsure 17: Xaa = Pro,Gln; position 17 of amino acid sequence; Xaa = Asn,Thr
aagttaggtttaaagtttcctcattaatgcaggaaaatgctcataacctgaggcttttcaagtgtttattaatttactttctggggctggctgctgatacttatttcagatcaaagagaaagcctgtgtctttcgtagttactgtgkkgcmaggaamctatgccacaggg

SEQ ID NO: 787 - DNA, 315 bp, Homo Sapiens
  Normal prostate
  sig_peptide 127..303: Von Heijne matrix; score 4.00; seq SVATALFPPLCIS/TG
accaagtcctcccaagttattaactggtcaaaaaggmttaaaggmttagttcttaatagttaagatgccacccattcagggttttttgctttctaagagggaacttttacaggcataattgagagaatgcatacatgctctctaccttgtcttctctttgctcagctgctagaattttgtagctttcctccagatgtgcctcataactgtgcgcctattgtctcagtcaggccgcctaatattgtagcagcctttgaagggtgctctgtagccactgctctttttcctcccttgtgcatctccacagggaatgag

SEQ ID NO: 788 - DNA, 342 bp, Homo Sapiens
  Hypertrophic prostate
  sig_peptide 55..138: Von Heijne matrix
  score 4.00
  unsure 54: seq PLLGVLFFQGVYI/VF; position 54 of amino acid sequence; Xaa = Phe,Leu,Val
agtcgttaccgggagctgtaaacaaggtgtgcaagcatctgaagagctgccgggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaagcttactatagactggacatatcgccctcccagcagcagccacacagtatcaataktkcattatcagtctttccagtacccaaccacagcaggcacattt

SEQ ID NO: 789 - DNA, 429 bp, Homo Sapiens
  Cancerous prostate
  sig_peptide 109..225: Von Heijne matrix
  score 3.90
  unsure -38: seq LILNRSLPTASSS/SS
  position -38 of amino acid sequence
  unsure -37: Xaa = His,Gln
  position -37 of amino acid sequence
  unsure 43: Xaa = Asp,Glu
  position 43 of amino acid sequence
  unsure 49: Xaa = Phe,Leu
  position 49 of amino acid sequence
  unsure 51: Xaa = Arg,Ser
  position 51 of amino acid sequence
  unsure 52: Xaa = Ile,Thr
  position 52 of amino acid sequence
  unsure 53: Xaa = Lys,Asn
  position 53 of amino acid sequence
  unsure 58: Xaa = Gly,Ser; position 58 of amino acid sequence; Xaa =  * ,Gly,Arg
aaaaatgtactgaatgtccactttgggccaggctgggcaccgaggacacaggggaactaagacacagtcctggtcactgggaaactcacagcctgttgggaaagaaagatgcamgavagtatcttcatttcagaaaaatatggactctgcccgtctaagactcccataatgaaaatgctcccgtctttgatcctgaaccggtcattgcccactgcttcaagcagttccagcaggaaggacttccgcctgcctcagacccgccggcgaatcatcatggtgcctcgcaaggaggatcagacaccccttaatcctgcatcccaacctcaggctcccccaaagcccatccccagcttsaaaagtytggaagctagmgataycaasrgcagccagaggacabgaagacctgggctgagcagaggtcgaagctgc

SEQ ID NO: 790 - DNA, 351 bp, Homo Sapiens
  Hypertrophic prostate
  sig_peptide 127..186: Von Heijne matrix
  score 3.90
  misc_feature 1..350: seq FFWVVLFSAGCKV/IT; blastn; identity 99.0999984741211; region 18..366; id D83597; vrt
atttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtacattgagaaagaagccaacaaaacatataactgtgaaaatttaggtctcagtgaaatccctgacactctaccaaacacaacagaatttttggaattcagctttaattttttgcctacaattcacaatagaacctccagcagg

SEQ ID NO: 791 - DNA, 410 bp, Homo Sapiens
  Normal prostate
  sig_peptide 96..383: Von Heijne matrix
  score 3.90
  unsure -72: seq IMNLTVMLDTAXG/KX
  position -72 of amino acid sequence
  unsure -54: Xaa = Phe,Leu,Val
  position -54 of amino acid sequence
  unsure -2: Xaa =  * ,Glu
  position -2 of amino acid sequence
  unsure 2: Xaa = Phe,Leu; position 2 of amino acid sequence; Xaa = Pro,Thr
agaaccacgccgcttcccagtctctgtgcgaggcgtgaagcgcggacctttcaacaagggctttattaattctcacgctgcggccctggaaagcgatggaggtggcggctaattgctccctacgggtgaagagacctctgttggatccccgcttcgagggttacaagbtctctcttgagccgctgccttgttaccagctggagcttgacgcagctgtggcakaggtaaaacttcgagatgatcaatatacactggaacacatgcatgcttttggaatgtataattacctgcactgtgattcatggtatcaagacagtgtctactatattgatacccttggaagaattatgaatttaacagtaatgctggacactgccttwggraaamcacgagaggtgtttcgactccta

SEQ ID NO: 792 - DNA, 347 bp, Homo Sapiens
  Normal prostate
  sig_peptide 63..179: Von Heijne matrix
  score 3.90
  unsure -32: seq VLAIGLLHIVLLS/IP
  position -32 of amino acid sequence
  unsure -31: Xaa = Arg,Ser
  position -31 of amino acid sequence
  unsure 31,45: Xaa =  * ,Glu,Lys
  position 31, 45 of amino acid sequence
  unsure 47: Xaa = Ser,Thr
  position 47 of amino acid sequence
  unsure 48: Xaa = Cys,Trp; position 48 of amino acid sequence; Xaa =  * ,Leu
agggaaccgatcccgggccgttgatcttcggccccacacgaacagcagagaggggcatcaggatgaatgtkggcacagcgcacagsdaggtgaaccccaacacgcgggtkatgaacagccgtggcatctggctctcctacgtgctggccatcggtctcctccacatcgtgctgctgagcatcccgtttgtkagtgtccctgtcgtctggaccctcaccaacctcattcacaacatgggcatgtatatcttcctgcacacggtgaaggggwcaccctttgagaccccggaccagggcaaggcgaggctgctwwcccactgktdagcagatggattatggggtccagtt

SEQ ID NO: 793 - DNA, 151 bp, Homo Sapiens
  Hypertrophic prostate
  sig_peptide 8..76: Von Heijne matrix; score 3.90; seq SWWTLLSSSPSFM/IS
atttattatggaaaactttaacatgtataaaaataagagctggtggacccttttgtcctcatcacccagctttatgatcagttttgtttcatctgtactaccagtgctacttaccatctctaggttcattttgaagcaaatcccagaccag

SEQ ID NO: 794 - DNA, 351 bp, Homo Sapiens
  Normal prostate
  sig_peptide 142..258: Von Heijne matrix
  score 3.90
  seq VLAIGLLHIVLLS/IP
  misc_feature 158: n=a, g, c or t
  unsure -34: position -34 of amino acid sequence; Xaa = Ala,Asp,Glu,Gly,Val
agattcggccggagctgccagcggggaggctgcagccgcgggttgttacagctgctggagcagcagcggcccccgctcccgggaaccgktcccgggccgttgrtcttcggccccacacgaacagcagagaggggcagcaggatgaatgtgggsacagndcacagcgaggtgaaccccaacacgcgggtgatgaacagccgtgggatctggctctcctacgtgctggccatcggtctcctccacatcgtgctcctgagcatcccgtttgtgagtgtccctgtcgtctggaccctcaccaacctcattcacaacatgggcatgtatatcttcctgtacacggtgaaggggaca

SEQ ID NO: 795 - DNA, 234 bp, Homo Sapiens
  Prostate
  sig_peptide 88..129: Von Heijne matrix; score 3.80; seq AAASAVSVLLVAA/ER
aabgcttcgtagtggaggaacgggtttggcgtgtgggacgcagctgcctctgtactggggagtcacggagtcccgggctccagggacatggcggcggcctctgcggtgtcggtgctgctggtggcggcggagaggaaccggtggcatcgtctcccgagcctgctcctgccgccgaggacatgggtgtggaggcaaagaaccatgaagtacacaacagccacaggaagaaacatg

SEQ ID NO: 796 - DNA, 461 bp, Homo Sapiens
  Cancerous prostate
  sig_peptide 177..308: Von Heijne matrix; score 3.80; seq SGSGLSWARLSQS/RS
actctttgccaccctcagaggcgagctgtggaagccttgactcttagggccgttttagaaccggggcctcggaccggcggggtttctgcacgtggaaccggaacatctgagatgatcgsmrggccctgtggagtgtggggagcgcgggagttctttcttccctcgaggcccgtgccatggcttactccaaagccagtgggtccccagtcctaagccaagcagtcccgggggaaaacgcttctcatcgccgtgggagcgcggatcttggaagtggctctgggctttcttgggcgaggctctcacagagtagatcggaaatccattctgctggcccgccccacctcggaggacggactaacggacctgagttcccggccctatcttactcttctcagcttctcagcttggctcagctcagaggaagaggaatcactgaagtctcagagaagtctccactcatc

SEQ ID NO: 797 - DNA, 459 bp, Homo Sapiens
  Normal prostate
  sig_peptide 175..285: Von Heijne matrix; score 3.80; seq RPVLLHLHQTAHA/DE
aggctccgcgctctggaggctcaggcgccgcgtggggcccgcacctctgggcagcagcggcagccgagactcacggtcaagctaaggcgaagagtgggtggctgaagccatactattttatagaattaatggraarcmhgaaaagmcatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattcaa

SEQ ID NO: 798 - DNA, 141 bp, Homo Sapiens
  Cancerous prostate
  sig_peptide 25..81: Von Heijne matrix; score 3.70; seq IPCAHMLVCPTIG/DI
aatttgtaagaatattatatatagatgatcatctgttatgatattccttgtgcacatatgttggtttgtcctactattggtgatattaagtttgatcacttgatgaagtggtatccatcagatttctctactgaaaggctg

SEQ ID NO: 799 - DNA, 393 bp, Homo Sapiens
  Cancerous prostate
  sig_peptide 184..240: Von Heijne matrix
  score 3.70
  seq STLASVPPAATFG/AD
  misc_feature 39: n=a, g, c or t
aaccaggctctatttagagccgggtaggggagcgcaggnccagatacctcagcgctacctggcggaactggatttctctcccgcctgccggcctgcctgccacagccggactccgccactccggtagccccatggctggmaacctgtgagattagcaatatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcg

SEQ ID NO: 800 - DNA, 263 bp, Homo Sapiens
  Normal prostate
  sig_peptide 54..248: Von Heijne matrix
  score 3.70
  unsure -60: seq QLEGLNWLRFSWA/QG
  position -60 of amino acid sequence
  unsure -52: Xaa = Ala,Ser
  position -52 of amino acid sequence
  unsure -50: Xaa =  * ,Lys,Leu,Met
  position -50 of amino acid sequence
  unsure -44: Xaa = Lys,Met
  position -44 of amino acid sequence
  unsure 4: Xaa = Gly,Trp; position 4 of amino acid sequence; Xaa = Asp,Phe,Val,Tyr
accctgaatacgaagaacataagcaaagctactggagacaccgagaactaattatgggggaagaccctkcccagccccgcaagtataagaagwwgaagawggagctacagggtgatkggcctcccagttctcccactaatgatcctaccgtgaaatatgagactcagccacggtttatcacagccactggaggcaccctgcacatgtatcagttggaagggctgaactggctacgcttctcctgggcccagggcactkwcggg

SEQ ID NO: 801 - DNA, 372 bp, Homo Sapiens
  Prostate
  sig_peptide 148..273: Von Heijne matrix
  score 3.70
  seq LLGCLQCCWLQSG/RA
  misc_feature 337: n=a, g, c or t
  unsure 22: position 22 of amino acid sequence; Xaa = Cys,Gly,Arg,Ser
accaattttgtagttatctgatctgaaggaagatgtgtgtggaggtgtttagtgatgttttccgatgacggtgattccccctaaatctacgtattaaatacaatggaacaggatccacagttcacccctaataatatagtttactgaatgttttatgtagctatgaccaaaactcacaaaaggatcagaagcctctgtaacatccaccatggtttgttccagtttactcagcagctcctgggctgtcttcagtgctgttggctgcaatcaggcagagccccagctacctattaccttgtggagagtattgaaaagtcagcacatggctctgtattangtacttatgatcaaactcagactcgcataggcagg

SEQ ID NO: 802 - DNA, 343 bp, Homo Sapiens
  Hypertrophic prostate
  sig_peptide 158..337: Von Heijne matrix
  score 3.70
  unsure -13: seq XTCASXNPSQCLA/AF
  position -13 of amino acid sequence
  unsure -8: Xaa = Leu,Met,Pro,Ser,Thr; position -8 of amino acid sequence; Xaa = Ala,Thr
acagaatctttaggtgggcctgttggtgaggtcacttttccctaatggtatattccagttcctgtagatcctattccagttcccaggacatattccaacctcgacctccagccaactttgaacccctgaagttgtgtgctgatgtgtttctaacaacatggtctcacccaaagatcttcctcttgtgcttttgcaggacattaaagttcccagctccatgactggatcacatgctggaaaccctcatatagaaaggaatgatctccccagacatggttctcctcaattttttacagghhygacttgtgcttctrcaaacccatctcagtgtctggcagcattt

SEQ ID NO: 803 - DNA, 78 bp, Homo Sapiens
  Prostate
  sig_peptide 1..45: Von Heijne matrix
  score 3.60
  unsure -12: seq FXSLFCLYFSCFL/HI
  position -12 of amino acid sequence
  unsure 6: Xaa = Phe,Val; position 6 of amino acid sequence; Xaa = Cys,Phe,Gly,Val
atggaatttktttctcttttctgtctctacttcagctgtttcctacatattatatattttkkcagctgtttcctatac

SEQ ID NO: 804 - DNA, 207 bp, Homo Sapiens
  Cancerous prostate
  sig_peptide 10..144: Von Heijne matrix
  score 3.60
  unsure -33: seq ALLELIDSPECLS/KC
  position -33 of amino acid sequence
  unsure 21: Xaa = Met,Val; position 21 of amino acid sequence; Xaa = Gly,Val
actgggaagatggcgctgcacttccagagtttggctgaattggaartgttatgtactcatctctacatagggactgatcttacacaaagaatagaggctgagaaagcactcttggaacttattgacagtccagaatgtctcagcaagtgtcaacttttattagaacaaggaacaacatcctatgctcagctccttgcagcaaccgkv

SEQ ID NO: 805 - DNA, 418 bp, Homo Sapiens
  Normal prostate
  sig_peptide 299..379: Von Heijne matrix; score 3.60; seq LTLLLITPSPSPL/LF
accttgggctccaaattctagctcataaagatgcaagtkttgcaatttcctataaatggttaagaaaagagcaagctgtccagagagtgagaagtttgaaaagagaggtgcataagagagaaatgatgtccatttgagccccaccacggaggttatgtggtcccaaaaggaatgatggccaagcaattaatttttcctcctagttcttagcttgcttctgcattgattggctttacacaactggcatttagtctgcattacacaaatagacactaatttatttggaacaagcagcaaaatgagaactttatttggtgcagtcagggctccatttagttccctcactctgcttctaatcaccccttctcccagccctcttctatttgatagaggtctgtccctcagatcagcaatgtcg

SEQ ID NO: 806 - DNA, 238 bp, Homo Sapiens
  Cancerous prostate
  sig_peptide 107..229: Von Heijne matrix; score 3.60; seq AVSSLIAVGTSHG/LA
acactcctatgatacttcatctgtggcaagctcagatagtggtgacaggaccaacttaaaaaggaagaagaaattacctgattctttttcacttcatggatcagttatgcgccattcacttttgaagggaatttctgcccagatagtgtctgcagctgacaaagtagatgctggcttgcctacagcaattgcagtatccagtctgatagcagtgggtacatctcatggattggctggg

SEQ ID NO: 807 - DNA, 188 bp, Homo Sapiens
  Normal prostate
  sig_peptide 120..164: Von Heijne matrix; score 3.50; seq LSCFIFFYISSLC/CF
tgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccaccagg

SEQ ID NO: 808 - DNA, 168 bp, Homo Sapiens
  Normal prostate
  sig_peptide 28..72: Von Heijne matrix; score 3.50; seq LCFLLPHHRLQEA/RQ
atagatcagtgacgtctttttcttcagatgatcctatgtttccttcttcctcatcatcgtcttcaggaagccagacagattcaagtattgaagatgctgccaagggaaaaattaagragaagragaagagagaaaacaaataaatgggaaaaaagaaagggcagcggg

SEQ ID NO: 809 - DNA, 135 bp, Homo Sapiens
  Normal prostate
  sig_peptide 64..105: Von Heijne matrix; score 3.50; seq FSLFALNMPLGFC/VY
tttattttaaccatcttttactatttttagaaggaaactagctttagtagtgggttgccctgtatgttttctctttttgctcttaatatgccattgggtttttgtgtgtatgtgattttcaaaattcatgactgg

SEQ ID NO: 810 - DNA, 303 bp, Homo Sapiens
  Cancerous prostate
  sig_peptide 163..255: Von Heijne matrix; score 3.50; seq SVWGVLPPPACSA/DL
atttgattttagtcagggtgtaagaatatgtattattgttcccaaaaaaatctgtgtaaaaacttcatagtgtgaaacagtggcaactgsktgattaaaacatcatttagaaaagacactcttccctgttttgaaattgactcctcaaaaggacagctgaacatggcctcttctccaggtgtcgccatgcactccctctgggccaccatacacacttctgtgtggggcgtgctcccacctccagcctgctcagctgatcttttgttcagcaatgcctgtctacttccccatgagatccacctg

SEQ ID NO: 811 - DNA, 317 bp, Homo Sapiens
  Prostate
  sig_peptide 60..194: Von Heijne matrix; score 3.50; seq LPRLLSLSQHSES/WI
agagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctctcattgtctcaacattctgaaagttggattgagcatattcaaattttgaaaattattgtagaaatgtttttacctcatatgaaccacctgacattggaacagactttcttttcacaagtgttaccaaagactgtgaaattattcgat

SEQ ID NO: 812 - DNA, 370 bp, Homo Sapiens
  Cancerous prostate
  sig_peptide 254..361: Von Heijne matrix; score 3.50; seq AAVVFAVVLSIHA/TV
agtaactgtgaggaaggctgcagagtggcgacgtctacgccgtaggttggaggctgtggggggtggccgggcgccagctcccaggccgcagaagtgacctgcggtggagttccctcctcgctgctggagaacggaagggaaraaggttsctggccgggtgaaagtgcctccctctgcttgacggggctgaggggcccgaagtctagggcgtccgtagtcgccccggcctccgtgaagccccaggtctagagatatgacccgagagtgcccatctccggccccggggcctggggctccgctgagtggatcggtgctggcagaggcggcagtagtgtttgcagtggtgctgagcatccacgcaaccgtatgg

SEQ ID NO: 813 - DNA, 470 bp, Homo Sapiens
  Normal prostate
  sig_peptide 216..269: Von Heijne matrix
  score 14.80
  misc_feature 369..470: seq LLWWALLLGLAQA/CP; blastn; identity 92; region 2..103; id AA059664; est
aagtggatggttccaggcaccctgtctggggcagggagggcacaggcctgcacatcgaaggtggggtgggaccaggctgcccctcgccccagcatccaagtcctcccttgggcgcccgtggccctggcagactctcagggctaaggtcctctgttgctttttggttccaccttagaagaggctcgcttgactaagagtagcttgaaggaggcaccatgcaggagctgcatctgctctggtgggcgcttctcctgggcctggctcaggcctgccctgagccctgcgactgtggggaaaagtatggcttccagatcgccgactgtgcctaccgcgacctagaatccgtgccgcctggcttcccggccaatgtgactacactgagcctgtcagccaaccggctgccaggcttgccggarggtgccttcagggaggtgcccctgctgcagtcgctgtggctggcacacaatgag

SEQ ID NO: 814 - DNA, 331 bp, Homo Sapiens
  Normal prostate
  sig_peptide 14..67: Von Heijne matrix
  score 13.60
  misc_feature 69..328: seq LLLLALCATGAQG/LY; blastn; identity 95; region 1..260
  id H96534
  est
  misc_feature 298: n=a, g, c or t
  unsure 77: position 77 of amino acid sequence
  unsure 78: Xaa = Ile,Met,Arg,Ser,Thr; position 78 of amino acid sequence; Xaa = Ala,Gly,Ser,Trp
ctctctgcgggcgatggggcggcaggccctgctgcttctcgcgctgtgcgccacaggcgcccaggggctctacttccacatcggcgagaccgagaagcgctgtttcatcgaggaaatccccgacgagaccatggtcatcggcaactatcgtacccagatgtgggataagcagaaggaggtcttcctgccctcgacccctggcctgggcatgcacgtggaagtgaaggaccccgacggcaaggtggtgctgtcccggcagtacggctcggagggccgcttcacgttcacctcccacabnksgggtgaccatcaaatctgtctgcactgcggg

SEQ ID NO: 815 - DNA, 195 bp, Homo Sapiens
  Normal prostate
  sig_peptide 76..138: Von Heijne matrix
  score 12.70
  misc_feature 90..129: seq ILFLLSWSGPLQG/QQ; blastn; identity 100; region 1..40
  id AA134726
  misc_feature 157..195: est; blastn; identity 100; region 66..104
  id AA134726
  misc_feature 124..156: est; blastn; identity 93; region 34..66
  id AA134726
  misc_feature 107..195: est; blastn; identity 96; region 1..89; id R17226; est
aagctaaccctcgggcttgaggggaagaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacgg

SEQ ID NO: 816 - DNA, 352 bp, Homo Sapiens
  Prostate
  sig_peptide 119..199: Von Heijne matrix
  score 8.80
  misc_feature 313..349: seq LLLLCPLSRGCCP/LL; blastn; identity 97; region 7..43
  id T67245
  unsure 5: est
  position 5 of amino acid sequence
  unsure 8: Xaa = Cys,Gly
  position 8 of amino acid sequence
  unsure 35: Xaa =  * ,Leu
  position 35 of amino acid sequence
  unsure 48: Xaa = His,Gln; position 48 of amino acid sequence; Xaa = Ala,Asp
acgttacctttgggtggtggttttcattcctgtgccgcctgcttctgggccagtgatccaggtgtctggtgaccacccgggcacagctgcttggctgctgtgggcacctcagcttcccatgtcctgtagggaactcacccaccggccttgctctccacacctcttactcctgtgtcccctttctcggggatgctgccccctcctgctgtcckgtccyctgtwaggggtgaatcttgaatccatcttatctcttactctccctccctctcccagctcagtcgggctctcaccctctgtgacccasctcacaacttcacctgtttcattgcactttgcatccgmcctcgccggg

SEQ ID NO: 817 - DNA, 447 bp, Homo Sapiens
  Normal prostate
  sig_peptide 85..150: Von Heijne matrix
  score 8.50
  misc_feature 113..306: seq AALLLGLMMVVTG/DE; blastn; identity 99; region 71..264
  id H83784
  misc_feature 42..111: est; blastn; identity 98; region 1..70
  id H83784
  misc_feature 378..414: est; blastn; identity 94; region 346..382
  id H83784
  misc_feature 305..340: est; blastn; identity 94; region 264..299
  id H83784
  misc_feature 250..350: est; blastn; identity 96; region 2..102
  id W32197
  misc_feature 392..449: est; blastn; identity 100; region 142..199
  id W32197
  misc_feature 349..390: est; blastn; identity 100; region 100..141
  id W32197
  misc_feature 397..449: est; blastn; identity 100; region 1..53
  id W37255
  unsure 43: est; position 43 of amino acid sequence; Xaa = Asp,Asn,Tyr
aacttgtgtccgggtggwrgactggattagctgcggascctggaagctgcctgtccttctccctgtgcttaaccagaggtgcccatgggttggacaatgaggctggtcacagcagcactgttactgggtctcatgatggtggtcactggagacgaggatgagaacagcccgtgtgcccatgaggccctcttggacgaggacaccctcttttgccagggccttgaagttttctacccagagttggggaacattggctgcaaggttgttcctgattgtdacaactacagacagaagatcacctcctggatggagccgatagtcaagttcccgggggccgtggacggcgcaacctatatcctggtgatggtggatccagatgcccctagcagagcagaacccagacagagattctggagacattggctggtaacagatatcaagggcgcc

SEQ ID NO: 818 - DNA, 217 bp, Homo Sapiens
  Normal prostate
  sig_peptide 119..190: Von Heijne matrix
  score 7.30
  misc_feature 125..182: seq VHLLSLCSGKVYA/RM; blastn; identity 100; region 6..63
  id R18560
  misc_feature 176..213: est; blastn; identity 92; region 58..95
  id R18560
  misc_feature 145..182: est; blastn; identity 100; region 1..38
  id R13864
  misc_feature 176..213: est; blastn; identity 92; region 33..70
  id R13864
  misc_feature 176..213: est; blastn; identity 92; region 2..39
  id HSC01E071
  est
  misc_feature 56: n=a, g, c or t
actgggagccgcctccgtcgccgccgtcagagccgccctatcagagttcctaccantttgtggttccagcagcttctgttccagattatcttaacaagaaaaccaactggaaaaaaaaatgaaattccttatcttcgcatttttcggtggtgttcaccttttatccctgtgctctgggaaagtatatgcaagaatggcatctctaagaggactcggg

SEQ ID NO: 819 - DNA, 433 bp, Homo Sapiens
  Cancerous prostate
  sig_peptide 167..253: Von Heijne matrix
  score 7.10
  misc_feature 139..361: seq LIFLCGAALLAVG/IW; blastn; identity 99; region 92..314
  id AA100852
  misc_feature 360..434: est; blastn; identity 100; region 314..388
  id AA100852
  misc_feature 139..434: est; blastn; identity 98; region 100..395
  id AA224847
  misc_feature 139..361: est; blastn; identity 98; region 92..314
  id AA161042
  misc_feature 368..434: est; blastn; identity 100; region 323..389
  id AA161042
  misc_feature 139..365: est; blastn; identity 98; region 87..313
  id H64488
  misc_feature 52..144: est; blastn; identity 92; region 1..93
  id H64488
  misc_feature 171..396: est; blastn; identity 100; region 129..354; id AA088770; est
aaaaagcgcctaccctgcctgcaggtgagcagtggtgtgtgagagccaggcgtccctctgcctgcccactcagtggcaacacccgggagctgttttgtcctttgtggagcctcagcagttccctctttcagaactyrvykgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttc

SEQ ID NO: 820 - DNA, 372 bp, Homo Sapiens
  Cancerous prostate
  sig_peptide 220..303: Von Heijne matrix
  score 6.60
  misc_feature 128..242: seq IVSLLGFVATVTL/IP; blastn; identity 92; region 1..115; id R58075; est
aagataggcgggtgcagcggggcagaacataggttgccttagagaggttccccggagtcccgacggcggctcaagtcagagttgctgggttttgctcagattggtgtgggaagagcctgcctgtggggagcggccactccatactgctgaggcctcaggactgctgctcagcttgcccgttacctgaagaggcggcggasgggcccctgaccggtcaccatgtgggccttctcggaattgcccatgccgctgctgatcaatttgatcgtctcgctgctgggatttgtggccacagtcaccctcatcccggccttccggggccacttcattgctgcgcgcctctgtggtcaggacctcaacaaaaccagccag

SEQ ID NO: 821 - DNA, 402 bp, Homo Sapiens
  Normal prostate
  sig_peptide 148..204: Von Heijne matrix
  score 6.30
  misc_feature 112..403: seq VLMRLVASAYSIA/QK; blastn; identity 97; region 33..324
  id H97426
  misc_feature 59..295: est; blastn; identity 98; region 2..238
  id W44834
  misc_feature 106..156: est; blastn; identity 96; region 4..54
  id R57989
  misc_feature 161..190: est; blastn; identity 93; region 62..91
  id R57989
  est
  misc_feature 318: n=a, g, c or t
  unsure 21: position 21 of amino acid sequence
  unsure 38: Xaa = Lys,Met,Arg
  position 38 of amino acid sequence
  unsure 61: Xaa = Arg,Ser; position 61 of amino acid sequence; Xaa = Ala,Glu,Lys,Thr
agctgaggtagggatgcsatccttctcaaaagacttattgacagtgccaaagctsggtactggacacaacgagggacctgggtctacgataacgcgcttktgctcctcctgaagtgtctttggtccaacgttgttccagagtgtaccatggcttccagtaacactgtgttgatgcggttggtagcctccgcatattctattgctcaaaaggcaggdatgatagtcagacgtgttattgctgaaggagacctgggtattgtggagadgacctgtgcaacagacctgcagaccaaagctgaccgattggcacagatgagnatatgttcttcattggcccggaaattccccaaactcacaattataggggaagaggatctgccttctrmggaagtggatcaagag

SEQ ID NO: 822 - DNA, 317 bp, Homo Sapiens
  Normal prostate
  sig_peptide 105..176: Von Heijne matrix
  score 5.90
  misc_feature 111..318: seq VHLLSLCSGKAIC/KN; blastn; identity 99; region 6..213
  id R18560
  misc_feature 131..318: est; blastn; identity 99; region 1..188
  id R13864
  misc_feature 162..318: est; blastn; identity 99; region 1..157
  id HSC01E071
  misc_feature 207..318: est; blastn; identity 99; region 1..112
  id AA016124
  unsure 41: est; position 41 of amino acid sequence; Xaa = Ala,Glu
aagtaaggctaggycgcgagcttagtcctgggagccgcctccgtcgccgccgtcagagccgccctatcagattatcttaacaagaaaaccaactggaaaaaaaaatgaaattccttatcttcgcatttttcggtggtgttcaccttttatccctgtgctctgggaaagctatatgcaagaatggcatctctaagaggacttttgaagaaataaaagaagaaatagccagctgtggagatgttgctaaagcaatcatcaacctagctgtttatggtaaagcccagaacagatcctatgmgcgattggcacttctggtt

SEQ ID NO: 823 - DNA, 499 bp, Homo Sapiens
  Normal prostate
  sig_peptide 146..298: Von Heijne matrix
  score 5.90
  misc_feature 160..401: seq ALXVLPLLGLHEA/AS; blastn; identity 95; region 59..300
  id H29377
  misc_feature 454..499: est; blastn; identity 100; region 356..401
  id H29377
  misc_feature 136..179: est; blastn; identity 95; region 36..79
  id H29377
  misc_feature 397..436: est; blastn; identity 97; region 297..336
  id H29377
  misc_feature 135..295: est; blastn; identity 95; region 293..453
  id N28905
  misc_feature 45..127: est; blastn; identity 93; region 4..86
  id N28905
  misc_feature 334..388: est; blastn; identity 94; region 489..543
  id N28905
  misc_feature 135..395: est; blastn; identity 97; region 81..341
  id H11885
  misc_feature 160..384: est; blastn; identity 95; region 105..329
  id H15231
  misc_feature 136..181: est; blastn; identity 93; region 82..127
  id H15231
  est
  misc_feature 143,266..267: n=a, g, c or t
  unsure -11: position -11 of amino acid sequence; Xaa = Ala,Cys,Asp,Phe,Gly,His,Ile,Leu,Asn,Pro,Arg,Ser,Thr,Val,Tyr
aacttccgggttcggcaataacctggagccggcggcgtaggttggctctttagggcttcaccccgaagctccaccttcgctcccgtctttctggaaacaccgctttgatctcggcggtgcgggacagacgctagtgtgagccnmcatggcagatacgaccccgaacggcccccaaggggcgggcgctgtgcaattcatgatgaccaataaactggacacggcaatgtggctttctcgcttgttcacagtttactgctctgctctgnntgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattc

SEQ ID NO: 824 - DNA, 219 bp, Homo Sapiens
  Cancerous prostate
  sig_peptide 1..72: Von Heijne matrix
  score 5.50
  misc_feature 45..221: seq XVLVLSVVXXAMA/AF; blastn; identity 93; region 1..177
  id HUMHBC4659
  misc_feature 63..221: est; blastn; identity 94; region 1..159
  id AA160569
  misc_feature 124..159: est; blastn; identity 97; region 97..132
  id R88362
  unsure -18: est
  position -18 of amino acid sequence
  unsure -16: Xaa =  * ,Cys
  position -16 of amino acid sequence
  unsure -13: Xaa =  * ,Leu
  position -13 of amino acid sequence
  unsure -5: Xaa = Lys,Gln
  position -5 of amino acid sequence
  unsure -4,40: Xaa = Ala,Pro
  position -4, 40 of amino acid sequence
  unsure 5: Xaa = Ala,Asp
  position 5 of amino acid sequence
  unsure 12: Xaa = Ala,Glu,Leu,Pro,Gln,Val
  position 12 of amino acid sequence
  unsure 16,17: Xaa = Ala,Gly,Pro,Arg
  position 16, 17 of amino acid sequence
  unsure 18: Xaa = Leu,Met; position 18 of amino acid sequence; Xaa = Leu,Pro
atgcgtttccgccatttttgmaaatwaattgggmaggtactggttttaagtgtagttsccgmcgcaatggcagcctttgcagtgshacctcaggggcccgcgttassmtctgaaccamtgmtgcygggttcacccacatctccaaagccaggagttaatgcccagttcttacctggatttttaatgggggmtttgccagctccggtgactccacaacct

SEQ ID NO: 825 - DNA, 483 bp, Homo Sapiens
  Normal prostate
  sig_peptide 1..120: Von Heijne matrix
  score 5.20
  misc_feature 105..414: seq LCVEFASVASCDA/AV; blastn; identity 99; region 1..310
  id T26956
  misc_feature 45..359: est; blastn; identity 98; region 1..315
  id T31666
  misc_feature 202..332: est; blastn; identity 100; region 137..267
  id R14990
  misc_feature 127..201: est; blastn; identity 100; region 63..137
  id R14990
  misc_feature 65..114: est; blastn; identity 100; region 1..50; id R14990; est
atggagttggggagttgcctggagggcgggagggaggcggcggaggaagagggcgagcctgaggtgaaaaagcggcgacttctgtgtgtggagtttgcctcggtcgcaagctgcgatgccgcagtggctcagtgcttcctggccgagaacgactgggagatggaaagggctctgaactcctacttcgagcctccggtggaggagagcgccttggaacgccgacctgaaaccatctctgagcccaagacctatgttgacctaaccaatgaagaaacaactgattccaccacttctaaaatcagcccatctgaagatactcagcaagaaaatggcagcatgttctctctcattacctggaatattgatggattagatctaaacaatctgtcagagagggctcgaggggtgtgttcctacttagctttgtacagcccagatgtgatatttctacaggaagttattcccccatattatagctaccta

SEQ ID NO: 826 - DNA, 444 bp, Homo Sapiens
  Hypertrophic prostate
  sig_peptide 13..378: Von Heijne matrix
  score 5.00
  misc_feature 182..401: seq RLVVVSVSPQSRA/SL; blastn; identity 96; region 165..384
  id W56608
  misc_feature 45..130: est; blastn; identity 98; region 30..115
  id W56608
  misc_feature 127..191: est; blastn; identity 96; region 111..175
  id W56608
  misc_feature 401..446: est; blastn; identity 97; region 385..430
  id W56608
  misc_feature 311..446: est; blastn; identity 99; region 1..136
  id R17248
  est
  misc_feature 226: n=a, g, c or t
  unsure -66: position -66 of amino acid sequence
  unsure -51: Xaa = Gly,Arg,Trp
  position -51 of amino acid sequence
  unsure 9: Xaa =  * ,Glu,Lys,Leu,Met,Gln,Val; position 9 of amino acid sequence; Xaa = Lys,Asn
agtgcggccgtcatggcgtcgcccttcagcggggcgctgcagctgacggacctggatgacttcatcgggccgtctcaggagtgcatcaagcctgtcaaagtggaaaaaagggcgggaagtggcgtggccaagattcgcattgaagatgacgggagctacttccaaattaaccaagacggcdggacccggaggctggagaaggccaaggtctcgctaaactactgcnwggcgtgcagcggctgcatcacctccgcagagaccgtgcttatcacccagcagagccacgaggagctgaagaaggttctagatgctaacaagatggcggcacccagtcagcagaggctggttgtagtttcggtctcaccacagtctagagcatcgctggctgcacggtttcagctgaawcctacagatactgccaggaaattaacctcattctttaaa

SEQ ID NO: 827 - DNA, 335 bp, Homo Sapiens
  Prostate
  sig_peptide 84..215: Von Heijne matrix
  score 4.80
  misc_feature 44..97: seq SLVAELLLGAGSG/SH; blastn; identity 92; region 1..54; id H30111; est
atactttctgyagyagtcctggacctcctgtgcaagaacatgaaacacctgtggttcatcctcctgctggtggcagctcccagatgggtcctgtcccgactgcagttgcaggggctggctcacgactggtaaagccctcacagaccctgtccctcacctgcgctgtctctggtggctcattagtagcggaacttcttcttggagctggatccggcagtcacctgggacgggcctggagtggattgggttcatctattatagaggcaatagtgggagtacttcttacaatccgtccctcaagactcgagccaccatatcactggacaagccccgcg

SEQ ID NO: 828 - DNA, 391 bp, Homo Sapiens
  Normal prostate
  sig_peptide 128..196: Von Heijne matrix
  score 4.40
  misc_feature 222..359: seq QFILLGTTSVVTA/AL; blastn; identity 92; region 33..170
  id T50032
  misc_feature 348..393: est; blastn; identity 100; region 160..205
  id T50032
  misc_feature 189..229: est; blastn; identity 97; region 1..41
  id T50032
  unsure 35: est; position 35 of amino acid sequence; Xaa = Ala,Gly
gactgatttcgagtttccggtcaggttaggccgggggggtgcggtcctggtcggaaggaggtggagagtcgggggtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagstccaggaaaatgcgtgccttatgctgttatagaaggagctgtgcggtctgttaaagaaacgcttaacagccagtttgtggaaaactgcaag

SEQ ID NO: 829 - DNA, 459 bp, Homo Sapiens
  Cancerous prostate
  sig_peptide 397..453: Von Heijne matrix
  score 4.10
  misc_feature 269..342: seq IYIICFXLPPLFS/FN; blastn; identity 97; region 2..75
  id R33746
  misc_feature 391..459: est; blastn; identity 94; region 124..192
  id R33746
  misc_feature 344..391: est; blastn; identity 95; region 78..125
  id R33746
  est
  misc_feature 343,394..395: n=a, g, c or t
  unsure -7: position -7 of amino acid sequence; Xaa = Phe,Tyr
atatataaatgtttcatgttattggttttgtacctagtcctttgcatggatatataggtacctaatgaaaatcgaggatcagtgtatgacaaatctcccatcctcccctttccttattgcctgtgtcggcaataggaagtagaatagttgtgtgttgtttacttacttgtctgttttagagagatttctatttttggtaggggaatattctaatatgttttcatatctttatttcattttgtagtcttttgcatggctatgtagggacctaatgaaagtcgagtttcataatatgacagctcacdtcttttcctacatatttcctcacttagcagtagctwgnkagttatkttgtggttattttatttcattctctaggatctattccatttgnngatgcaagtgtgtagatgcatatatatcatttgcttctwtcttccgccattattttcctttaac

SEQ ID NO: 830 - DNA, 193 bp, Homo Sapiens
  Normal prostate
  sig_peptide 44..88: Von Heijne matrix
  score 4.10
  misc_feature 44..193: seq QRLLLRFLASVIS/RK; blastn; identity 96.0999984741211; region 1..152
  id HSU78678
  misc_feature 112..193: vrt; blastn; identity 96; region 90..171
  id N41898
  misc_feature 112..193: est; blastn; identity 98; region 95..176
  id H69272
  misc_feature 112..193: est; blastn; identity 97; region 39..120; id N20619; est
gggagggctaggctgtgcatccctccgctcgcattgcagggagatggctcagcgacttcttctgaggttcctggcctctgtcatctccaggaagccctctcarggtcagtgggccacccctcacttccagagccctgcagaccccacaatgcagtcctggtggcctgactgtaacacccaacccagcccggac

SEQ ID NO: 831 - DNA, 280 bp, Homo Sapiens
  Cancerous prostate
  sig_peptide 143..262: Von Heijne matrix
  score 3.90
  misc_feature 111..277: seq FLWLITRPQPVLP/LL; blastn; identity 99; region 3..169
  id AA149704
  unsure 6: est; position 6 of amino acid sequence; Xaa = Leu,Arg
aagtcctaggagctgtggaaagagtagaagtgcctgaatgtggtgctgaatcaatacagccagctgtgaggggagcacttcctggacccaggaagggagagtcttcttccaaggtctgaatttcctgctgctgttcacaaagatgctttttatctttaactttttgttttccccacttccgaccccggcgttgatctgcatcctgacatttggagctgccatcttcttgtggctgatcaccagacctcaacccgtcttacctcttcttgacctgaacckg

SEQ ID NO: 832 - DNA, 443 bp, Homo Sapiens
  Hypertrophic prostate
  sig_peptide 297..434: Von Heijne matrix
  score 3.90
  misc_feature 323..443: seq SHMLQLLPSKALC/LF; blastn; identity 100; region 2..122
  id R84934
  misc_feature 323..390: est; blastn; identity 97; region 1..68
  id AA020870
  misc_feature 373..443: est; blastn; identity 92; region 52..122
  id AA020870
  misc_feature complement(407..438): est; blastn; identity 90; region 42..73; id AA187611; est
tttgtgggctcctctttggggtgaccactgctttcaaagccatctgccaaggctctccagggcaggacctgactggtggggaatgagtgttcagaagccttgggagaggccaaagagccattctaggatgrtckgaggaaaaccttcctgcagaggccagaaaccttgagcttaggtgcctggggaccagcttcgacattctctccagtttctgattctaatttttgccacgtgtcacaacttttccagtctctgagaaggtcccagvctttctcaaatattctgattttgaaaatatgtatccaaagtgggaggcccctgtgacattttgccaacttaaacgagaaaaagaccccccgcacccggcacactcccccttcctccagccccgcttcagccacatgctccagctgctgcccagtaaagccctgtgcctttttttc

SEQ ID NO: 833 - DNA, 215 bp, Homo Sapiens
  Cancerous prostate
  sig_peptide 36..167: Von Heijne matrix
  score 3.70
  misc_feature 42..151: seq LAERLGLFEELWA/AQ; blastn; identity 98; region 1..110
  id AA121585
  misc_feature 143..214: est; blastn; identity 95; region 101..172
  id AA121585
  misc_feature 42..136: est; blastn; identity 100; region 1..95
  id AA100539
  misc_feature 143..214: est; blastn; identity 95; region 100..171; id AA100539; est
actgtttgaggatgtaggcactggtgtgaaggaacatggccctgtatcagaggtggcggtgtctccggctccaaggtttacaggcttgcaggctacacacggcagttgtgtcgacccctccacgctggttggcagagcggcttggcctttttgaggagctgtgggctgctcaggtaaagagattagcaagcatggcacagaaggaaccccagacg

SEQ ID NO: 834 - DNA, 280 bp, Homo Sapiens
  Normal prostate
  sig_peptide 98..166: Von Heijne matrix
  score 13.80
  misc_feature 57..276: seq XGLLLFLLPGSLG/AE; blastn; identity 95; region 22..241
  id C16912
  misc_feature 172..260: est; blastn; identity 91; region 64..152
  id T68684
  misc_feature 132..164: est; blastn; identity 96; region 26..58
  id T68684
  unsure -13: est
  position -13 of amino acid sequence
  unsure 38: Xaa = Leu,Val; position 38 of amino acid sequence; Xaa = His,Gln
agagagaggaactggggtctccagtcacgggagccaggagccggccagggccgcagsaggaagggagcgaggctgaagggaacgtcgtcctctcagcatgggggtcccgcggcctcagccctgggcgstggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacccgagccak

SEQ ID NO: 835 - DNA, 354 bp, Homo Sapiens
  Cancerous prostate
  sig_peptide 28..162: Von Heijne matrix
  score 13.40
  misc_feature 2..249: seq LVLALXLVSAALS/SV; blastn; identity 98; region 5..252
  id C18087
  misc_feature 166..350: est; blastn; identity 96; region 20..204
  id AA018305
  misc_feature 187..350: est; blastn; identity 94; region 42..205
  id AA015592
  misc_feature 181..350: est; blastn; identity 96; region 33..202
  id AA018631
  misc_feature 150..181: est; blastn; identity 100; region 1..32
  id AA018631
  misc_feature 158..338: est; blastn; identity 95; region 12..192
  id R93954
  est
  misc_feature 301,314: n=a, g, c or t
  unsure -8: position -8 of amino acid sequence
  unsure 46: Xaa = Leu,Met,Val
  position 46 of amino acid sequence
  unsure 47: Xaa = Ile,Met,Thr
  position 47 of amino acid sequence
  unsure 51: Xaa = Ala,Pro,Ser,Thr
  position 51 of amino acid sequence
  unsure 56: Xaa = Ala,Glu,Gly,Ile,Lys,Leu,Pro,Gln,Arg,Thr,Val; position 56 of amino acid sequence; Xaa = Phe,Ser
aagcgcaggctcccagccgagtccgttatggccgctgccgtcccgaagaggatgagggggccagcacaagcgaaactgctgcccgggtcggccatccaagcccttgtggggttggcgcggccgctggtcttggcgctcvtgcttgtgtccgccgctctatccagtgttgtatcacggactgattcaccgagcccaaccgtactcaactcacatatttctaccccaaatgtgaatgctttaacacatgaaaaccaaaccaaaccttctatttcccaaatcagcaccaccctccctcccayrncgagtaccaagvnaagtggaggagcatytgtggtccctcatccctcgccaggg

SEQ ID NO: 836 - DNA, 334 bp, Homo Sapiens
  Cancerous prostate
  sig_peptide 137..223: Von Heijne matrix
  score 13.00
  misc_feature 170..322: seq LLLVLLLVTRXRS/MP; blastn; identity 96; region 117..269
  id HSC3DG011
  misc_feature 53..184: est; blastn; identity 91; region 1..132
  id HSC3DG011
  misc_feature complement(177..209): est; blastn; identity 90; region 337..369
  id H41589
  est
  misc_feature 73: n=a, g, c or t
  unsure -3: position -3 of amino acid sequence
  unsure 18: Xaa = Ser,Thr; position 18 of amino acid sequence; Xaa = Leu,Val
aatttgtgcggcgctggtcccctcagagggttcctgctgctgccggtgccttggaccctccccctcgcttcsngttctactgccccaggagcccggcgggtccgggactcccgkccgtgccggtgcgggcgccggcatgtggctgtgggaggaccagggcggcctcctgggccctttctccttcctgctgctagtgctgctgctggtgacgcggasccggtcaatgcctgcctcctcaccggcagcctcttcgttctactgcgcgtcttcagctbtgagccggtgccctcttgcagggccctgcaggtgctcaagccccgggaccgcatttctg

SEQ ID NO: 837 - DNA, 281 bp, Homo Sapiens
  Normal prostate
  sig_peptide 36..119: Von Heijne matrix
  score 11.60
  misc_feature 24..280: seq LLLLVQLLRFLRA/DG; blastn; identity 99; region 28..284
  id R02745
  misc_feature 3..176: est; blastn; identity 98; region 6..179
  id T84331
  misc_feature 172..280: est; blastn; identity 98; region 176..284
  id T84331
  misc_feature 27..280: est; blastn; identity 100; region 1..254
  id AA017512
  misc_feature 27..280: est; blastn; identity 99; region 1..254
  id N95074
  misc_feature 173..280: est; blastn; identity 99; region 146..253
  id N75564
  misc_feature 65..151: est; blastn; identity 100; region 40..126
  id N75564
  misc_feature 27..66: est; blastn; identity 92; region 1..40; id N75564; est
atttcttccccccgagctgggcgtgcgcggccgcaatgaactgggagctgctgctgtggctgctggtgctgtgcgcgctgctcctgctcttggtgcagctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggagtttctcttgtgctgtcagccagg

SEQ ID NO: 838 - DNA, 344 bp, Homo Sapiens
  Normal prostate
  sig_peptide 177..236: Von Heijne matrix
  score 11.20
  misc_feature 163..344: seq AFLLLVALSYTLA/RD; blastn; identity 96; region 35..216
  id T86663
  misc_feature 163..278: est; blastn; identity 97; region 43..158; id AA055880; est
agaagataatcacttggggaaaggaaggttcgtttctgagttagcaacaagtaaatgcagcactagtgggtgggattgaggtatgccctggtgcataaatagagactcagctgtgctggcacactcagaagcttggaccgcatcctagccgccgactcacacaaggcagagttgccatggaaaaaattccagtgtcagcattcttgctccttgtggccctctcctacactctggccagagataccacagtcaaacctggagccaaaaaggacacaaaggactctcgacccaaactgccccagaccctctccagaggttggggtgaccaactcatctggacacgg

SEQ ID NO: 839 - DNA, 312 bp, Homo Sapiens
  Cancerous prostate
  sig_peptide 127..246: Von Heijne matrix
  score 11.20
  misc_feature 171..312: seq AFLLLVALSYTLA/RD; blastn; identity 95; region 33..174
  id T86663
  misc_feature 171..288: est; blastn; identity 97; region 41..158; id AA055880; est
aagattcacaaggccaacagacaacccaaagtcattaagccatgagagtggaatgaatctatgaaaactcaatgaagacagaacaagagaaaaatcttttcagccacgatgaattaggrgaacaagatgtcaaattacactgatgctgagtcaagcttctcaaagcaagagataatcagagttgccatggagaaaattccagtgtcagcattcttgctccttgtggccctctcctacactctggccagagataccacagtcaaacctggagccaaaaaggacacaaaggactctcgacccaaaccgccccgg

SEQ ID NO: 840 - DNA, 326 bp, Homo Sapiens
  Cancerous prostate
  sig_peptide 3..161: Von Heijne matrix
  score 10.60
  misc_feature 96..165: seq FILLLIFIAEVAA/AV; blastn; identity 100; region 364..433
  id AA100852
  misc_feature 45..95: est; blastn; identity 100; region 314..364
  id AA100852
  misc_feature 14..46: est; blastn; identity 100; region 282..314
  id AA100852
  misc_feature 96..202: est; blastn; identity 94; region 65..171
  id AA113841
  misc_feature 31..95: est; blastn; identity 100; region 1..65
  id AA113841
  misc_feature 290..324: est; blastn; identity 97; region 326..360
  id AA133048
  misc_feature 158..191: est; blastn; identity 97; region 2..35
  id AA133048
  misc_feature 169..290: est; blastn; identity 97; region 1..122
  id AA159272
  misc_feature 53..95: est; blastn; identity 100; region 323..365
  id AA161042
  misc_feature 96..138: est; blastn; identity 100; region 365..407
  id AA161042
  misc_feature 14..46: est; blastn; identity 100; region 282..314
  id AA161042
  est
  misc_feature 13,184: n=a, g, c or t
  unsure -50: position -50 of amino acid sequence
  unsure 8: Xaa = Ala,Glu,Gly,Val
  position 8 of amino acid sequence
  unsure 11: Xaa = Ile,Asn,Ser,Thr
  position 11 of amino acid sequence
  unsure 37: Xaa = Ala,Pro,Ser; position 37 of amino acid sequence; Xaa = Leu,Trp
acatgcagtttgnaacgtgggctacttcctcatcgcagccggcgttgtggtctttgctcttggtttcctgggctgctatggtgctaagactgagaagcaagtgtgccctcgtgacgttcttcttcatcctcctcctcatcttcattgctgaggttgcagctgctgtggtcgccttggtgtacancacaatgbctgagcacttcctgacgttgctggtagtgcctgccatcaagaaagattatggttcccaggaagacttcactcaagtgtkgaacaccaccatgaaagggctcaagtgctgtggcttcaccaactatacggactgg

SEQ ID NO: 841 - DNA, 335 bp, Homo Sapiens
  Hypertrophic prostate
  sig_peptide 3..86: Von Heijne matrix
  score 10.50
  misc_feature 140..276: seq LLLLVHLLRFLRA/DG; blastn; identity 98; region 147..283
  id N36076
  misc_feature 32..140: est; blastn; identity 98; region 40..148
  id N36076
  misc_feature 287..333: est; blastn; identity 97; region 296..342
  id N36076
  misc_feature 1..33: est; blastn; identity 90; region 8..40
  id N36076
  misc_feature 2..333: est; blastn; identity 98; region 9..340
  id N95074
  misc_feature 2..333: est; blastn; identity 98; region 9..340
  id AA017512
  misc_feature 140..333: est; blastn; identity 98; region 146..339
  id W04626
  misc_feature 5..140: est; blastn; identity 97; region 12..147
  id W04626
  misc_feature 45..334: est; blastn; identity 97; region 47..336
  id H27747
  misc_feature 1..34: est; blastn; identity 97; region 1..34
  id H27747
  unsure 47: est
  position 47 of amino acid sequence
  unsure 73: Xaa = Phe,Val; position 73 of amino acid sequence; Xaa = Lys,Arg
aaatgaactgggagctgctgctgtggctgctggtgctgtgcgcgctgctcctgctcttggtgcatctgctgcgcttcctgagggctgacggcgacctgacgctactatgggccgagtggcagggacgacgcccagaatgggagctgactgatatggtggtgtgggtgactggagcctcgagtggaattggtgaggagctggcttaccagttgtctaaactaggwktttctcttgtgctgtcagccagaagagtgcatgagctggaaagggtgaaaagaagatgcctagagaatggcaatttaaragaaaaagatatacttgttttgccccttggg

SEQ ID NO: 842 - DNA, 347 bp, Homo Sapiens
  Normal prostate
  sig_peptide 120..272: Von Heijne matrix
  score 10.30
  misc_feature 53..162: seq VSCLTLWSPGCWP/QP; blastn; identity 100; region 424..533
  id N80896
  misc_feature complement(283..318): est; blastn; identity 100; region 342..377
  id W16873
  misc_feature 293..347: est; blastn; identity 100; region 1..55; id R02710; est
tgcactatgcttgtgtgtatgtgtgtgcctctgtcttgctctcttatctcccagcagtgagacattggacgtgtttgctcatgaagatgcagtatatggcttgtctgtgagcccagtgaatgacaacatttttgccagttcctcagatgatggccgggttctcatttgggacattcgggaatccccccatggagagcccttctgcctggcaaactatccatcagcctttcatagtgtcatgtttaaccctgtggagcccaggttgttggccacagccaattcaaaggaaggagtgggactctgggacattcgaaaacctcagagttctctcctgcgctatggtggaa

SEQ ID NO: 843 - DNA, 461 bp, Homo Sapiens
  Cancerous prostate
  sig_peptide 75..158: Von Heijne matrix
  score 9.50
  misc_feature 168..461: seq LVXFSLLATAILG/AV; blastn; identity 99; region 47..340
  id N39924
  misc_feature 169..370: est; blastn; identity 96; region 178..379
  id R61601
  misc_feature 359..431: est; blastn; identity 100; region 369..441
  id R61601
  unsure -11: est; position -11 of amino acid sequence; Xaa = Phe,Ser
accataccaaattaaatgactgccataaagtatattttactcacaggacagattacaatagccttgatagaatcatggcatccaaagggatgcgccatttttgcttgatttcagagcagttggtgtyctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactg

SEQ ID NO: 844 - DNA, 296 bp, Homo Sapiens
  Hypertrophic prostate
  sig_peptide 78..140: Von Heijne matrix
  score 9.30
  misc_feature complement(31..239): seq VLPVILLLLGAHP/SP; blastn; identity 93; region 3..211
  id N27605
  misc_feature complement(2..111): est; blastn; identity 99; region 1..110
  id N78549
  unsure 23: est; position 23 of amino acid sequence; Xaa = Gly,Ile,Ser,Val
aagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacrktccgataccgtcggggaaaaattattttagttttggaaagatcctcttcagaaataccactatcttcctgaagtttgatggagaacga

SEQ ID NO: 845 - DNA, 468 bp, Homo Sapiens
  Cancerous prostate
  sig_peptide 130..456: Von Heijne matrix
  score 9.10
  misc_feature 118..281: seq LVLAVLFFHQLVG/DP; blastn; identity 96; region 78..241
  id R57572
  misc_feature 38..91: est; blastn; identity 98; region 1..54
  id R57572
  misc_feature 90..122: est; blastn; identity 93; region 52..84
  id R57572
  misc_feature 117..272: est; blastn; identity 94; region 59..214
  id W55468
  misc_feature 273..328: est; blastn; identity 91; region 214..269
  id W55468
  est
  misc_feature 258..259: n=a, g, c or t
  unsure -66: position -66 of amino acid sequence; Xaa = Asp,His,Asn,Tyr
actttgtcattcagctgcctgctgcctccgcagcgtccccccagctctccctgtgctaactgcctgcaccttggacagagcgggtgcgcaaatcagaaggattagttgggacctgcccttggcgaccccatggcatcccccagaaccgtaactattgtggccctctcagtggccctgggactcttctttgttttcatggggactatcaagctgacccccaggctcagcaaggatgcctacagtgagatgaaacgtgcnnacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaa

SEQ ID NO: 846 - DNA, 225 bp, Homo Sapiens
  Normal prostate
  sig_peptide 91..204: Von Heijne matrix
  score 8.80
  misc_feature 88..221: seq LLLLCALHSHIYC/IK; blastn; identity 100; region 84..217
  id AA021055
  misc_feature 5..74: est; blastn; identity 97; region 1..70
  id AA021055
  misc_feature 88..221: est; blastn; identity 100; region 84..217
  id W98068
  misc_feature 5..74: est; blastn; identity 97; region 1..70
  id W98068
  misc_feature 88..191: est; blastn; identity 99; region 11..114; id AA059040; est
cataaaatttgaggatatcagctgattattttttcttccmasaatgaaaatcaagcagaattgattcctacacgaaaaaaaagcacacgaatgccaaacctttcctttggtggactggacactaaccagatgagagtaaatttcttatccgtggacgtatgtaagctactgctgctgtgtgctctccacagccatatttattgtattaaacaatcagcacttcgg

SEQ ID NO: 847 - DNA, 470 bp, Homo Sapiens
  Normal prostate
  sig_peptide 258..422: Von Heijne matrix
  score 8.80
  misc_feature 134..378: seq XXLLLLNVGQLLA/QT; blastn; identity 97; region 115..359
  id R67703
  misc_feature 23..135: est; blastn; identity 92; region 5..117
  id R67703
  misc_feature 134..318: est; blastn; identity 98; region 115..299
  id H42383
  misc_feature 20..135: est; blastn; identity 98; region 2..117
  id H42383
  misc_feature 193..383: est; blastn; identity 100; region 87..277
  id W90193
  misc_feature 134..192: est; blastn; identity 96; region 29..87
  id W90193
  misc_feature 417..454: est; blastn; identity 92; region 314..351
  id W90193
  misc_feature 288..470: est; blastn; identity 97; region 1..183
  id R53752
  est
  misc_feature 384,389: n=a, g, c or t
  unsure -12: position -12 of amino acid sequence
  unsure -13: Xaa =  * ,Cys,Phe,Leu,Trp,Tyr; position -13 of amino acid sequence; Xaa = Gly,Arg,Trp
aacccacggtggggggagcgcggccatggcgctcctgctttcggtgctgcgtgtactgctgggcggcttcttcgcgctcgtggggttggccaagctctcggaggagatctcggctccagtttcggagcggrtgraatgccctgttcgtgcagtttgctgatgtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctgnggtdnctgctgctgctgaatgtcggccagctcttagcccagactaagaaggtggtcagacccactaggaagaagactctaagtaca

SEQ ID NO: 848 - DNA, 354 bp, Homo Sapiens
  Cancerous prostate
  sig_peptide 133..345: Von Heijne matrix
  score 8.60
  misc_feature 4..55: seq VVXFLLLLAXLIA/TY; blastn; identity 98; region 19..70
  id T18977
  misc_feature 141..195: est; blastn; identity 90; region 157..211
  id T18977
  misc_feature 92..137: est; blastn; identity 93; region 109..154
  id T18977
  misc_feature 245..355: est; blastn; identity 94; region 1..111
  id HSC12A111
  misc_feature 321..355: est; blastn; identity 94; region 1..35
  id W73324
  est
  misc_feature 72..73,138..140: n=a, g, c or t
  unsure -70: position -70 of amino acid sequence
  unsure -69: Xaa = Asp,Glu,Ile,Lys,Met,Asn,Val
  position -69 of amino acid sequence
  unsure -16: Xaa = any one of the twenty amino acids
  position -16 of amino acid sequence
  unsure -15: Xaa = His,Gln
  position -15 of amino acid sequence
  unsure -11: Xaa = Arg,Ser
  position -11 of amino acid sequence
  unsure -4: Xaa = Ser,Thr; position -4 of amino acid sequence; Xaa = Gly,Arg,Trp
aagcagcttccaggatcctgagatccggagcagccggggtcggagcggctcctcaagagttactgatctatnnatggcagagaaaaaaaaattgtgaccagagacgtgtagcaatgaacaaggaacrtcataatgrwnnnkttcacagacccctcttcagtgaatgaaaagaagaggagggagcgggaagaaaggcagaatattgtcctgtggagacagccgctcattaccttgcagtatttttctctggaaatccttgtaatcttgaaggaatggacctcaaaattatggcatcgtcammgcattgtggtgwcttttttactgctgcttgctdggcttatagctacgtattat

SEQ ID NO: 849 - DNA, 311 bp, Homo Sapiens
  Normal prostate
  sig_peptide 249..293: Von Heijne matrix
  score 8.60
  misc_feature 189..311: seq LLRGLLWXQVLCA/GP; blastn; identity 97; region 75..197
  id AA021160
  est
  misc_feature 58,167: n=a, g, c or t
  unsure -6: position -6 of amino acid sequence; Xaa = Leu,Val
acctttctgggttgagcatggctgaagtgactcagcccatgggaggtttcctaggagnaacaggctccacttgctgcctctctgcgtgaactccgtgtgccggcaacctggcgaccagactcctgccttcggaggggctggggctccaggacctgagtgccccccrnkgttggaaggcggtgtcatatgtgcacagaagccaaaaagcattgctggtatttcgaaggactctatccaaccyhttatatatgccgctcctacgaggactgctgtggstccaggtgctgtgtgcgggccctctccatacagag

SEQ ID NO: 850 - DNA, 353 bp, Homo Sapiens
  Cancerous prostate
  sig_peptide 159..218: Von Heijne matrix
  score 8.40
  misc_feature 121..355: seq AVVGCLLVPPAEA/NK; blastn; identity 99; region 31..265
  id T78247
  misc_feature 121..355: est; blastn; identity 99; region 6..240
  id W17118
  misc_feature 121..355: est; blastn; identity 99; region 11..245
  id N88433
  misc_feature 121..336: est; blastn; identity 99; region 32..247
  id R35014
  misc_feature 121..329: est; blastn; identity 99; region 9..217
  id AA074562
  unsure 8: est; position 8 of amino acid sequence; Xaa = Gln,Arg
aagaggcggagatggcggagggcggtgggacgtgatgcgcgggtcagagccgggccttgagaaggaactggaggcccctggcagcggtgtcccctcgaggacccctctgccgggctcaccaggtgtccggctttgctggcccagcaagcctgataagcatgaagctcttatctttggtggctgtggtcgggtgtttgctggtgcccccagctgaagccaacaagagttctgaagatatccrgtgcaaatgcatctgtccaccttatagaaacatcagtgggcacatttacaaccagaatgtatcccagaaggactgcaactgcctgcacgtggtggagcccatgccagtgccg

SEQ ID NO: 851 - DNA, 320 bp, Homo Sapiens
  Normal prostate
  sig_peptide 114..185: Von Heijne matrix
  score 7.90
  misc_feature 2..319: seq LLLPRVLLTMASG/SP; blastn; identity 98; region 15..332
  id HUM085F04B
  misc_feature 139..249: est; blastn; identity 100; region 187..297
  id H85714
  misc_feature 249..319: est; blastn; identity 97; region 298..368
  id H85714
  misc_feature 86..148: est; blastn; identity 92; region 133..195
  id H85714
  misc_feature 135..319: est; blastn; identity 98; region 80..264
  id R77008
  misc_feature 86..319: est; blastn; identity 98; region 94..327
  id H49758
  misc_feature 135..319: est; blastn; identity 98; region 53..237; id AA056366; est
aattggctggctctggaggcgcaggtggtccttcttctactgtcacatggtgcgcgctgttttctaatcacgkggctgccacccaggcctctctgctcctgtcktktgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtkggggagaagcgg

SEQ ID NO: 852 - DNA, 384 bp, Homo Sapiens
  Normal prostate
  sig_peptide 28..351: Von Heijne matrix
  score 7.90
  misc_feature 121..381: seq LLGLLSAEQLAEA/SV; blastn; identity 96; region 73..333
  id H95186
  misc_feature 72..133: est; blastn; identity 95; region 25..86
  id H95186
  unsure -17: est
  position -17 of amino acid sequence
  unsure -16: Xaa = Phe,Leu; position -16 of amino acid sequence; Xaa = Gly,Arg
acgggtgccgggtggagcgaasacggaatgtgtctcctgctgggggccacgggcgtcgggaagacgctgctggtgaaacggctgcaggaggtgagctcccgggatgggaaaggcgacctgggggagccgcccccgacacggcccacggtgggcaccaatcttactgacatcgtggcacagagaaagatcaccatccgggagcttggggggtgcatgggccccatctggtccagttactatggaaactgccgttctctcctgtttgtgatggacgcctctgaccccacccagctctctgcattmsgtgtgcagctcttaggtctcctttctgcagaacaacttgcagaagcatcggtgctgatactcttcaataaaatcgacaac

SEQ ID NO: 853 - DNA, 236 bp, Homo Sapiens
  Normal prostate
  sig_peptide 75..197: Von Heijne matrix
  score 7.70
  misc_feature 94..197: seq LLCLGQLHHPGLG/RV; blastn; identity 97; region 92..195
  id T93931
  misc_feature 2..45: est; blastn; identity 100; region 1..44
  id T93931
  misc_feature 53..97: est; blastn; identity 93; region 52..96
  id T93931
  misc_feature 190..234: est; blastn; identity 91; region 187..231
  id T93931
  misc_feature 138..196: est; blastn; identity 100; region 241..299
  id N25481
  misc_feature 190..234: est; blastn; identity 93; region 292..336
  id N25481
  misc_feature 94..211: est; blastn; identity 95; region 65..182
  id W19370
  misc_feature 94..196: est; blastn; identity 97; region 56..158
  id N35539
  misc_feature 190..234: est; blastn; identity 93; region 151..195
  id N35539
  misc_feature 56..97: est; blastn; identity 92; region 19..60
  id N35539
  misc_feature 94..193: est; blastn; identity 97; region 96..195
  id W87436
  misc_feature 2..49: est; blastn; identity 93; region 7..54; id W87436; est
aaagtttgttccccgagttcggagcctaggagccccccgcggctgcggcgcaggtgccctcggccttagtcgggatggagctgcctgckgtgaaccttgaaagtgattctcctaggtcactggctgctgacaacctggggctgcattgtattctcaggctcctatgcctgggccaacttcaccatcctggccttgggcgtgtgggctgtggctcagcgggactccatcgacgccgg

SEQ ID NO: 854 - DNA, 329 bp, Homo Sapiens
  Normal prostate
  sig_peptide 171..323: Von Heijne matrix
  score 7.60
  misc_feature 145..240: seq PALILLFALGSLG/SG; blastn; identity 95; region 99..194
  id N28787
  misc_feature 45..139: est; blastn; identity 96; region 1..95
  id N28787
  misc_feature 253..326: est; blastn; identity 98; region 207..280
  id N28787
  misc_feature 145..239: est; blastn; identity 93; region 114..208
  id AA102327
  misc_feature 59..139: est; blastn; identity 97; region 30..110
  id AA102327
  misc_feature 31..63: est; blastn; identity 96; region 1..33
  id AA102327
  misc_feature 277..311: est; blastn; identity 91; region 250..284
  id AA102327
  misc_feature 145..240: est; blastn; identity 96; region 101..196
  id AA019783
  misc_feature 253..326: est; blastn; identity 98; region 209..282
  id AA019783
  misc_feature 79..139: est; blastn; identity 95; region 37..97
  id AA019783
  misc_feature 145..240: est; blastn; identity 95; region 115..210
  id AA059290
  misc_feature 41..139: est; blastn; identity 90; region 13..111
  id AA059290
  misc_feature 253..319: est; blastn; identity 92; region 223..289
  id AA059290
  misc_feature 145..240: est; blastn; identity 96; region 102..197
  id H86516
  misc_feature 253..326: est; blastn; identity 98; region 210..283
  id H86516
  misc_feature 75..139: est; blastn; identity 100; region 34..98; id H86516; est
agctcttcctcgcggaagtggggaggaggcggttgcggttagtggaccgggaccggtaggggtgctgttgccatcatggctgaccccgacccccggtaccctcgctcctcgatcgaggacgacttcaactatggcagcaagcgtkggcytcsgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggttcgggg

SEQ ID NO: 855 - DNA, 207 bp, Homo Sapiens
  Cancerous prostate
  sig_peptide 25..111: Von Heijne matrix
  score 7.60
  misc_feature 23..202: seq PTLAIALAANAWA/FV; blastn; identity 99; region 1..180; id W88492; est
accatatgggtggtgtggatcgtcatgtatacttacggcaacaagcagcacaacagtcccacctgggatgaccccacgctggccatcgccctcgccgccaatgcctgggccttcgtcctcttctacgtcatccccgaggtctcccaggtgaccaagtccagcccagagcaaagctaccagggggacatgtaccccacccgggacttg

SEQ ID NO: 856 - DNA, 195 bp, Homo Sapiens
  Normal prostate
  sig_peptide 70..165: Von Heijne matrix
  score 7.60
  misc_feature complement(136..167): seq WILVLALPLTVWP/WL; blastn; identity 90; region 239..270; id H62766; est
actttcagtttccttcttccagcacggagtacactgctctgcctccacttagattacttcagaaatgaaatgcagcaaatatttatccagcagtgcagggagttgaacttttggagtcgggaaccttggattcttgttctggctctgccacttactgtgtggccttggctctccccggaggctcagccccctctg

SEQ ID NO: 857 - DNA, 373 bp, Homo Sapiens
  Cancerous prostate
  sig_peptide 110..154: Von Heijne matrix
  score 7.50
  misc_feature 308..370: seq AVLLALLMAGLAL/QP; blastn; identity 98; region 404..466
  id AA158879
  est
  misc_feature 72..73: n=a, g, c or t
  unsure 12: position 12 of amino acid sequence
  unsure 16: Xaa = Lys,Arg
  position 16 of amino acid sequence
  unsure 58: Xaa = Gly,Ser; position 58 of amino acid sequence; Xaa = Asp,His
aactggctccaggaaacccgctggtgttgactgtgggcagtccagcctctccccatttgaggccatataaannacctgaggccctctccaccacagcccaccagtgaccatgaaggctgtgctgcttgccctgttgatggcaggcttggccctgcagccaggcactgccctgctgtgctactcctggarrgcccaggtgrgcaacgaggactgcctgcaggtggagaactgcacccagctgggggagcagtgctggaccgcgcgcatccgcgcagttggcctcctgaccgtcatcagcaaaggctgcagcttgaactgcgtggatsactcacaggactactacgtgggcaagaagaacatcacgtgctgtgac

SEQ ID NO: 858 - DNA, 249 bp, Homo Sapiens
  Normal prostate
  sig_peptide 4..51: Von Heijne matrix
  score 7.10
  misc_feature 1..247: seq QACLLGLFALILS/GK; blastn; identity 100; region 1..247; id AA166578; est
agaatgggactccaagcctgcctcctagggctctttgccctcatcctctctggcaaatgcagttacagcccggagcccgaccagcggaggacgctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggaaaatacctgacccgt

SEQ ID NO: 859 - DNA, 382 bp, Homo Sapiens
  Cancerous prostate
  sig_peptide 2..88: Von Heijne matrix
  score 7.00
  misc_feature complement(141..361): seq LGSGLGLSPGTSS/GR; blastn; identity 97; region 146..366
  id H19708
  misc_feature 143..264: est; blastn; identity 98; region 143..264
  id H20045
  misc_feature 1..74: est; blastn; identity 100; region 4..77
  id H20045
  misc_feature 143..382: est; blastn; identity 98; region 8..247
  id C15772
  misc_feature 157..341: est; blastn; identity 98; region 1..185
  id H67240
  misc_feature 340..382: est; blastn; identity 100; region 185..227
  id H67240
  misc_feature 172..382: est; blastn; identity 97; region 1..211
  id HUM408E11B
  unsure 15: est
  position 15 of amino acid sequence
  unsure 16: Xaa = Asp,Gly
  position 16 of amino acid sequence
  unsure 18: Xaa = Pro,Ser
  position 18 of amino acid sequence
  unsure 68: Xaa = Phe,Ile,Val
  position 68 of amino acid sequence
  unsure 78: Xaa = Ala,Thr
  position 78 of amino acid sequence
  unsure 83: Xaa = Asn,Thr; position 83 of amino acid sequence; Xaa = Leu,Val
gatgaggccggggcaggtctccctcctgggtcctgatgctgtttctgtgctcggctctggcttgggcctcagccctggcaccagctctggccgcaaccctgaccctggctctgggccgggcactctgccggrtyccagcdtccaaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccarccctgatcccaaccctgtgtcctgccctgamccctgttctcccastcgtggcactgtcagcccagccctccctaccggcgagagtccagagt

SEQ ID NO: 860 - DNA, 138 bp, Homo Sapiens
  Cancerous prostate
  sig_peptide 10..108: Von Heijne matrix
  score 6.80
  misc_feature complement(2..139): seq FTSASLLLPMSTG/MP; blastn; identity 96; region 135..272; id HSB82C022; est
attatttatatgattaacccctcagtccctagcaagtcaaattcccatccgtttttatctacagtaatgttcacctctgcatcactgctgcttcccatgtctacaggcatgccaactcaaaactgttttaccccaaag

SEQ ID NO: 861 - DNA, 406 bp, Homo Sapiens
  Cancerous prostate
  sig_peptide 83..286: Von Heijne matrix
  score 6.70
  misc_feature 138..186: seq IACLAWWIGGGSG/XN; blastn; identity 91; region 14..62
  id AA111755
  est
  misc_feature 287..288: n=a, g, c or t
  unsure -63: position -63 of amino acid sequence
  unsure 1: Xaa = Asn,Ser,Thr; position 1 of amino acid sequence; Xaa = any one of the twenty amino acids
aaagactttgcgaasgctgcgctcgcgcccggatccctcaggcggctgcaggcttcagcctgcgctggttggtgaaacagagatgtcagaaaaggagavcaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggnnbaacttcggcctggccttcgtgtggctgctcctgttcacgccttgcggctacgtgtgctggttccggcctgtctacaaggccttccgagccgacagctcctttaatttcatggcgctg

SEQ ID NO: 862 - DNA, 347 bp, Homo Sapiens
  Normal prostate
  sig_peptide 159..227: Von Heijne matrix
  score 6.70
  misc_feature complement(68..131): seq ILRLYFFLQLAHS/GY; blastn; identity 95; region 392..455
  id W22335
  misc_feature 288..347: est; blastn; identity 95; region 9..68
  id H70453
  unsure 24: est
  position 24 of amino acid sequence
  unsure 32: Xaa = Ser,Thr; position 32 of amino acid sequence; Xaa = Glu,Gly
acgaaatggtattgacatcttggttggaacacctggtcgtatcaaagaccatctgcagagtggccgattggatctttctaaactgcgacatgttgtgcttgatgaagtggatcagatgttagatttaggtttcgctgaacaagttgaagatattattcatgaatcctacaaaactgattctgaagacaatcctcagactttacttttttctgcaacttgcccacagtgggtatacaaagttgcaaaaaaaatacatgaaatccagatatgaacaggttgaccttgttggraaaatgwctcaaaaggctgcaactactgtggracatttggccatccagtgtcattgg

SEQ ID NO: 863 - DNA, 406 bp, Homo Sapiens
  Normal prostate
  sig_peptide 38..106: Von Heijne matrix
  score 6.70
  misc_feature 12..70: seq SXXCFVSVPPASA/IP; blastn; identity 96; region 1..59
  id AA013305
  misc_feature 197..250: est; blastn; identity 100; region 189..242
  id AA013305
  misc_feature 250..297: est; blastn; identity 97; region 243..290
  id AA013305
  misc_feature 136..199: est; blastn; identity 98; region 236..299
  id R48472
  misc_feature 37..101: est; blastn; identity 96; region 135..199
  id R48472
  est
  misc_feature 74,128..129,364,367: n=a, g, c or t
  unsure -12: position -12 of amino acid sequence
  unsure -11: Xaa = Cys,Trp
  position -11 of amino acid sequence
  unsure 3: Xaa = Asp,His,Asn,Tyr
  position 3 of amino acid sequence
  unsure 5: Xaa = Ala,Gly
  position 5 of amino acid sequence
  unsure 6: Xaa = Ile,Ser
  position 6 of amino acid sequence
  unsure 8: Xaa = Phe,Leu
  position 8 of amino acid sequence
  unsure 12: Xaa =  * ,Ala,Cys,Asp,Glu,Phe,Gly,His,Ile,Lys,Leu,Asn,Pro,Gln,Arg,Ser,Thr,Val,Tyr
  position 12 of amino acid sequence
  unsure 65: Xaa = Gly,Arg
  position 65 of amino acid sequence
  unsure 87: Xaa = Ala,Asp,Glu; position 87 of amino acid sequence; Xaa = Gly,Val
aacccgggaccgagctggggtcttggaggaagagaggatggcgtcgtcgagccctgactccccatgttcctgsnactgctttgtctccgtgcccccggcctcagccatcccggstgtgakcttkgccnnhaactcggacsgaccccgggacgaggtgcaggaggtggtgtttgtccccgcaggcactcacactcctgggagccggctccagtgcacctacattgaagtggaacaggtgtcgaagacgcacgctgtgattctgagccgtccttcttggctatggggggctgagatgggcgmvacgagcatggtgtctgcattggcaacgaggctgtgtggacgaaggagccagttggggagggcngkngccctsctgggcatggacctactcaggtgcagaccctgc

SEQ ID NO: 864 - DNA, 308 bp, Homo Sapiens
  Normal prostate
  sig_peptide 171..287: Von Heijne matrix
  score 6.70
  misc_feature 128..197: seq XLIAXLEPPGAMA/VR; blastn; identity 97; region 158..227
  id AA249540
  misc_feature 241..309: est; blastn; identity 92; region 267..335
  id AA249540
  misc_feature 164..240: est; blastn; identity 97; region 58..134
  id N46699
  misc_feature 128..161: est; blastn; identity 100; region 23..56
  id N46699
  misc_feature complement(224..309): est; blastn; identity 96; region 104..189
  id W39777
  misc_feature 233..309: est; blastn; identity 96; region 13..89
  id AA036848
  misc_feature 233..309: est; blastn; identity 96; region 13..89
  id AA133513
  unsure -38: est
  position -38 of amino acid sequence
  unsure -13: Xaa = Ala,Gly
  position -13 of amino acid sequence
  unsure -9: Xaa = Phe,Leu; position -9 of amino acid sequence; Xaa = Ile,Leu,Val
cattattccttttccatcggaagtggcgctcgtgcattcaacttgttcccgctcatggaacccctctttaaaaagacgcagggcacctgtgagcgcaggagcgagcctaaggccacccagcggcagcgcccgtgtcctgggcactcagcgtgctgggcagagcaggtgcgatggscccagtcctagcagccctcgcccatgtcctgtgcccttacatggctcccggactgtgcagggagccgatacgtttkctgatagcavtactggaaccaccgggtgcgatggcagtkaggagactgcccagtgcc

SEQ ID NO: 865 - DNA, 327 bp, Homo Sapiens
  Hypertrophic prostate
  sig_peptide 73..207: Von Heijne matrix
  score 6.70
  misc_feature 19..327: seq PMLGLAAFRWIWS/RE; blastn; identity 99; region 1..309
  id C16848
  misc_feature 75..104: est; blastn; identity 96; region 303..332
  id R40385
  unsure 35: est; position 35 of amino acid sequence; Xaa = Asp,Glu
aaaagcggacccgcggacggtggcgttaagggaacgctgaggtcccgcgctccccgaccgaggtatatctccatgaataacctaaatgatcccccaaattggaatatccggcctaattccagggcggatggtggtgatggaagcaggtggaattatgccctgttggttccaatgctgggattggctgcttttcgttggatttggtctagggagtcccagaaagaagtagaaaaagagagagaagcctaccgtcggagaactgctgcttttcaacaggatctggaagccaagtaccacgccatgatctcagamaatcggcgtgctgtc

SEQ ID NO: 866 - DNA, 381 bp, Homo Sapiens
  Normal prostate
  sig_peptide 295..351: Von Heijne matrix
  score 6.60
  misc_feature complement(3..297): seq AALCSLFFFLSLQ/EI; blastn; identity 99; region 1..295
  id W57719
  misc_feature complement(37..300): est; blastn; identity 99; region 10..273
  id H04979
  misc_feature complement(7..41): est; blastn; identity 97; region 270..304
  id H04979
  misc_feature complement(37..295): est; blastn; identity 99; region 7..265
  id H10390
  misc_feature complement(2..41): est; blastn; identity 97; region 262..301
  id H10390
  misc_feature complement(142..295): est; blastn; identity 99; region 1..154
  id W42765
  misc_feature complement(2..141): est; blastn; identity 100; region 156..295
  id W42765
  misc_feature complement(55..238): est; blastn; identity 98; region 71..254
  id R39116
  misc_feature complement(255..297): est; blastn; identity 100; region 10..52; id R39116; est
acgttagggggccagggagatgtgactgaggctggctttccacgtgaatgagacggggtcggtggagggtttggtgctacagccagtcagaagatttgcaaatgcgaacacattcctgtgtgaggcacgttaccctttgtcagttattgtgaatatgtgtattttaagcaataagattcagctggtcagacttttctgggcagtctcagtgacgcatttcctgtgctgtgattgttctgaagacagagtggctctaaccactgtgagaagcccaaataaaaattgatcccaaaaatgctactgctctttcttgctgcactttgttccctcttcttcttcctcagtcttcaggaaattgcacctcaagatcccaaaccaggg

SEQ ID NO: 867 - DNA, 178 bp, Homo Sapiens
  Normal prostate
  sig_peptide 2..142: Von Heijne matrix
  score 6.50
  misc_feature 17..175: seq IIVCLFAFLVAHC/FL; blastn; identity 91; region 1..159
  id W51023
  misc_feature 42..173: est; blastn; identity 98; region 1..132; id T61976; est
tatgttattccttggcaaggtgctgatagtctgcagcacaggtttagctggsattatgctgctcaactaccagcaggactacacagtatgggtgctgcctctgatcatcgtctgcctctttgctttcctagtcgctcattgcttcctgtctatttatgaaatggtagtkgatgcgagg

SEQ ID NO: 868 - DNA, 319 bp, Homo Sapiens
  Cancerous prostate
  sig_peptide 191..304: Von Heijne matrix
  score 6.30
  misc_feature complement(2..321): seq LLLLVHSFWFTVC/TP; blastn; identity 100; region 59..378
  id AA045815
  misc_feature 95..244: est; blastn; identity 99; region 1..150
  id R18658
  misc_feature 240..321: est; blastn; identity 100; region 147..228
  id R18658
  misc_feature 95..321: est; blastn; identity 100; region 1..227
  id R14615
  misc_feature complement(2..200): est; blastn; identity 100; region 3..201
  id N95174
  misc_feature complement(36..197): est; blastn; identity 98; region 8..169
  id N93742
  misc_feature complement(2..44): est; blastn; identity 100; region 166..208; id N93742; est
aagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtcttt

SEQ ID NO: 869 - DNA, 360 bp, Homo Sapiens
  Normal prostate
  sig_peptide 199..279: Von Heijne matrix
  score 6.30
  misc_feature complement(131..360): seq LFCVLLSLRPHTS/GT; blastn; identity 100; region 45..274
  id M78402
  misc_feature complement(57..234): est; blastn; identity 100; region 10..187
  id H04786
  misc_feature complement(7..43): est; blastn; identity 97; region 201..237
  id H04786
  misc_feature complement(57..234): est; blastn; identity 98; region 10..187
  id H17078
  misc_feature complement(7..43): est; blastn; identity 97; region 201..237
  id H17078
  misc_feature complement(57..217): est; blastn; identity 100; region 1..161
  id HSC0UC022
  misc_feature complement(1..43): est; blastn; identity 100; region 175..217; id HSC0UC022; est
acaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgca

SEQ ID NO: 870 - DNA, 438 bp, Homo Sapiens
  Cancerous prostate
  sig_peptide 34..225: Von Heijne matrix
  score 6.30
  misc_feature 135..426: seq VLMRLVASAYSIA/QK; blastn; identity 97; region 35..326
  id H97426
  misc_feature 92..316: est; blastn; identity 95; region 14..238
  id W44834
  misc_feature 127..177: est; blastn; identity 96; region 4..54
  id R57989
  misc_feature 182..211: est; blastn; identity 93; region 62..91
  id R57989
  misc_feature complement(287..316): est; blastn; identity 96; region 385..414
  id N93806
  est
  misc_feature 377: n=a, g, c or t
  unsure -46: position -46 of amino acid sequence
  unsure -45: Xaa = Ala,Asp,His,Asn,Pro,Thr
  position -45 of amino acid sequence
  unsure -43: Xaa = Glu,Gly
  position -43 of amino acid sequence
  unsure -38: Xaa = Pro,Thr
  position -38 of amino acid sequence
  unsure -35: Xaa = Asp,Asn
  position -35 of amino acid sequence
  unsure 44: Xaa = Leu,Val
  position 44 of amino acid sequence
  unsure 45: Xaa = Ala,Val
  position 45 of amino acid sequence
  unsure 51: Xaa = Gly,Arg,Trp
  position 51 of amino acid sequence
  unsure 71: Xaa = Ala,Glu,Gly,Ile,Lys,Met,Arg,Thr,Val; position 71 of amino acid sequence; Xaa = Arg,Ser
aagtttcccgcatgctcagtagctgaggtagggatgccatccttctcaaaagacttattgacagtgccaaagctcggtactggacacvmcgrrggrmctgggtcctacgatracgcgcttktgctcctcctgaagtgtctttggtccaacgttgttccagagtgtaccatggcttccagtaacactgtgttgatgcggttggtagcctccgcatattctattgctcaaaaggcaggaatgatagtcagacgtgttattgctgaaggagacctgggtattgtggagaagacctgtgcaacagacctgcagaccaaagctgaccgattggcacagatgagcatatgttcttcattggymbggaaattccccaaactcrnrattataggggaagaggatctgccttctgaggaagtggatcaagagctgattgaagacagk

SEQ ID NO: 871 - DNA, 310 bp, Homo Sapiens
  Hypertrophic prostate
  sig_peptide 227..289: Von Heijne matrix
  score 6.20
  misc_feature 7..113: seq LEMLXAFASHIXA/RD; blastn; identity 98; region 15..121
  id W04921
  misc_feature 114..220: est; blastn; identity 98; region 121..227
  id W04921
  misc_feature 221..310: est; blastn; identity 93; region 227..316
  id W04921
  misc_feature complement(114..213): est; blastn; identity 98; region 260..359
  id N70602
  misc_feature complement(32..113): est; blastn; identity 97; region 359..440
  id N70602
  misc_feature complement(261..311): est; blastn; identity 92; region 164..214
  id N70602
  misc_feature complement(213..259): est; blastn; identity 95; region 215..261
  id N70602
  misc_feature 114..194: est; blastn; identity 96; region 59..139
  id W70167
  misc_feature 238..311: est; blastn; identity 94; region 183..256
  id W70167
  misc_feature 55..113: est; blastn; identity 96; region 1..59
  id W70167
  misc_feature 193..236: est; blastn; identity 95; region 139..182
  id W70167
  misc_feature 221..311: est; blastn; identity 91; region 165..255
  id W37690
  misc_feature 114..187: est; blastn; identity 97; region 58..131
  id W37690
  misc_feature 56..113: est; blastn; identity 96; region 1..58
  id W37690
  misc_feature 185..220: est; blastn; identity 97; region 130..165
  id W37690
  est
  misc_feature 264: n=a, g, c or t
  unsure -9: position -9 of amino acid sequence
  unsure -2: Xaa = Ile,Lys,Asn,Arg,Ser,Thr; position -2 of amino acid sequence; Xaa = Arg,Trp
atggcagcttccttggctcggcttggtctgcggcctgtcaaacaggttcgggttcagttctgtcccttcgagaaaaacgtggaatcgacgaggaccttcvtscagacggtgaggcmgtgagaaggtccgctccactaatctcaactgctcagtgattgcggacgtgasgcatgacggctccgagccctgcgtggacgtgctgttcggagacgggcatcgcctgattatgcgcggcgctcatctcaccgctctggaaatgctcanmgccttcgcctcccacatmhgggccagggacgcggcgggcagcggg

SEQ ID NO: 872 - DNA, 429 bp, Homo Sapiens
  Cancerous prostate
  sig_peptide 7..423: Von Heijne matrix
  score 6.20
  misc_feature 321..431: seq FGLLHQLSQCVTS/LE; blastn; identity 99; region 186..296
  id AA043558
  misc_feature 218..299: est; blastn; identity 93; region 83..164
  id AA043558
  misc_feature 173..230: est; blastn; identity 100; region 39..96
  id AA043558
  misc_feature 131..299: est; blastn; identity 97; region 57..225
  id N50523
  misc_feature 321..431: est; blastn; identity 98; region 247..357
  id N50523
  misc_feature complement(45..115): est; blastn; identity 98; region 1..71
  id N50523
  misc_feature complement(321..431): est; blastn; identity 98; region 289..399
  id AA115605
  misc_feature complement(217..318): est; blastn; identity 97; region 403..504
  id AA115605
  misc_feature complement(166..231): est; blastn; identity 92; region 491..556
  id AA115605
  misc_feature 172..318: est; blastn; identity 99; region 36..182
  id AA115129
  misc_feature 321..431: est; blastn; identity 98; region 186..296
  id AA115129
  misc_feature 174..318: est; blastn; identity 99; region 41..185
  id AA035548
  misc_feature 325..431: est; blastn; identity 99; region 194..300
  id AA035548
  est
  misc_feature 319..320: n=a, g, c or t
  unsure -97: position -97 of amino acid sequence
  unsure -42: Xaa = Ala,Thr
  position -42 of amino acid sequence
  unsure -35: Xaa = Asp,Glu; position -35 of amino acid sequence; Xaa =  * ,Ala,Glu,Gly,Lys,Leu,Met,Pro,Gln,Arg,Ser,Thr,Val,Trp
acaaggatggaagtgggcttaccggccattaccctctttctcaccagcgccagcagccctgtggtggcgacgacgatggaccaggagccagtgggcggtgtggaacgaggagaagccgtcgcagcctcgggarctgcggccgccgcggcattcggggaatctgcagggcagatgagtaacgaaagaggctttgaaaatgtagaactgggagtcataggaaaaaagaagaaagtcccaaggagagtcatccactttgttagtggtgaaacaatggaagaatatagcacagatgaagacgahgttgatggcctggagaagnngatgttttgcctactgttgatccgrcaaaacttacctggggtccctacttatggttttacatgcttcgggctgctacatcaactctctcagtgtgtgacttccttggag

SEQ ID NO: 873 - DNA, 321 bp, Homo Sapiens
  Cancerous prostate
  sig_peptide 151..279: Von Heijne matrix
  score 6.10
  misc_feature 102..322: seq SAATLASLGGTSS/RR; blastn; identity 98; region 31..251
  id T34679
  misc_feature 176..322: est; blastn; identity 99; region 104..250
  id N34677
  misc_feature 93..170: est; blastn; identity 91; region 21..98
  id N34677
  misc_feature 180..312: est; blastn; identity 100; region 203..335
  id N32531
  misc_feature 180..312: est; blastn; identity 100; region 202..334
  id N36824
  misc_feature 102..170: est; blastn; identity 97; region 28..96
  id N36824
  misc_feature 175..312: est; blastn; identity 100; region 100..237; id H97539; est
aactctcgtgccaagcatgtctctccaaatggctgctctctggcgttcctcacactccccctgaagttcatctaagatcttcattcttcawaggcggaagcccggctcgctgcaaaacgggcggcccgcgcggaggctcgcgagatccgcatgaaggagctggagcggcagcagaaggaggtagaagagagaccagaaaaagattttactgagaaggggtctcgtaacatgccgggcctgtctgcagccacgctggcctctctgggtgggacttcctctcggagaggcagcggagacacctccatctccatcgaccccgag

SEQ ID NO: 874 - DNA, 401 bp, Homo Sapiens
  Normal prostate
  sig_peptide 126..188: Von Heijne matrix
  score 6.10
  misc_feature 270..403: seq VLVILCIVTVCVT/IV; blastn; identity 92; region 199..332
  id AA125491
  misc_feature 70..135: est; blastn; identity 93; region 1..66
  id AA125491
  misc_feature complement(27..135): est; blastn; identity 98; region 89..197
  id HSB72F052
  misc_feature complement(135..223): est; blastn; identity 98; region 2..90; id HSB72F052; est
accggagaaaaaatggttcatggagcctgcggttattgtttgcctgggtggaattttaccttttggttcaatctttattgaaatgtatttcatcttcacgtctttctgggcatataagatctattatgtctatgggcttcatgatgctggtgctggttatcctgtgcattgtgactgtctgtgtgactattgtgtgcacatattttctactaaatgcagaagattacaggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgatt

SEQ ID NO: 875 - DNA, 466 bp, Homo Sapiens
  Normal prostate
  sig_peptide 128..337: Von Heijne matrix
  score 6.00
  misc_feature 153..397: seq LLFPLTLVRSFWS/DM; blastn; identity 97; region 131..375
  id W56159
  misc_feature 19..139: est; blastn; identity 100; region 1..121
  id W56159
  misc_feature 153..467: est; blastn; identity 95; region 303..617
  id HSZ78368
  misc_feature 60..139: est; blastn; identity 97; region 214..293
  id HSZ78368
  misc_feature 153..374: est; blastn; identity 97; region 80..301
  id AA026570
  misc_feature 70..139: est; blastn; identity 100; region 1..70
  id AA026570
  misc_feature 372..405: est; blastn; identity 94; region 300..333
  id AA026570
  misc_feature 155..467: est; blastn; identity 90; region 83..395
  id AA109961
  misc_feature 88..139: est; blastn; identity 92; region 20..71
  id AA109961
  misc_feature 153..363: est; blastn; identity 96; region 274..484
  id AA046907
  misc_feature 60..139: est; blastn; identity 97; region 185..264
  id AA046907
  unsure -66: est
  position -66 of amino acid sequence
  unsure -63: Xaa = Asp,Glu,Gly
  position -63 of amino acid sequence
  unsure -62: Xaa = Ile,Ser
  position -62 of amino acid sequence
  unsure -59: Xaa = Glu,Gly
  position -59 of amino acid sequence
  unsure -57: Xaa = Gly,Leu,Val,Trp
  position -57 of amino acid sequence
  unsure 10: Xaa = Cys,Trp
  position 10 of amino acid sequence
  unsure 22: Xaa = Ile,Ar
  position 22 of amino acid sequence
  unsure 24: Xaa = Ala,Asp
  position 24 of amino acid sequence
  unsure 28: Xaa = Lys,Gln; position 28 of amino acid sequence; Xaa = Cys,Phe
aacgcttgcgatggttgaattcccctcctcacgccagcctaggagaagaagttcgtagtcccagaggaagaggagttgtacgcatgtcagagaggttgcaggctgttttcaatttgtcagtttgtggatgatggaattggrmctwaaaakcgraactaaakkggaatgkgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcakaacctcttcatggactttttatcttcaagccgatgmcggmmaaatagttatatkccagtctaagccagaaatccagtacgcaccacatttggagcaggag

SEQ ID NO: 876 - DNA, 81 bp, Homo Sapiens
  Normal prostate
  sig_peptide 1..72: Von Heijne matrix
  score 6.00
  misc_feature 18..81: seq GLILLFASHLINQ/FS; blastn; identity 98; region 62..125
  id AA092155
  misc_feature complement(18..81): est; blastn; identity 98; region 68..131
  id AA128307
  misc_feature complement(18..81): est; blastn; identity 98; region 68..131
  id N99068
  misc_feature complement(18..81): est; blastn; identity 98; region 68..131
  id AA039944
  misc_feature complement(18..81): est; blastn; identity 96; region 68..131; id AA128099; est
atggtttccaatgcttcrgagacttcctgcctaggcctcatcctcctctttgccagtcacctgattaaccaattctccagc

SEQ ID NO: 877 - DNA, 373 bp, Homo Sapiens
  Hypertrophic prostate
  sig_peptide 2..220: Von Heijne matrix
  score 6.00
  misc_feature 29..302: seq LIVFISVCTALLA/EG; blastn; identity 99; region 1..274
  id H18735
  misc_feature 143..302: est; blastn; identity 100; region 116..275
  id T80360
  misc_feature 79..143: est; blastn; identity 92; region 51..115
  id T80360
  misc_feature 29..69: est; blastn; identity 100; region 1..41
  id T80360
  misc_feature 66..302: est; blastn; identity 99; region 1..237
  id AA137006
  misc_feature 301..336: est; blastn; identity 94; region 412..447
  id AA137006
  misc_feature 65..302: est; blastn; identity 98; region 2..239
  id HSC2CA081
  misc_feature 64..224: est; blastn; identity 98; region 1..161
  id T36290
  misc_feature 223..302: est; blastn; identity 98; region 161..240
  id T36290
  unsure -29: est
  position -29 of amino acid sequence
  unsure 36: Xaa = Leu,Met,Val
  position 36 of amino acid sequence
  unsure 45: Xaa = Ser,Thr
  position 45 of amino acid sequence
  unsure 48: Xaa = Asp,His; position 48 of amino acid sequence; Xaa = Ala,Thr
aatgccccggaagcggaagtgcgatcttcgggctgtcagagttggtctgttactcggtggtggcggagtctacggaagccgttttcgcttcacttttcctggctgtagagcgctttccccctggcgggtgagavtgcagagacgaaggtgcgagatgagcactatgttcgcggacactctcctcatcgtttttatctctgtgtgcacggctctgctcgcagagggcataacctgggtcctggtttacaggacagacaagtacaagagactgaaggcagaagtggaaaaacagagtaaaaaatatttgatggtagagtggtggcaaascttccttttttacccctctttcttasatccaaagrctgtctcatcg

SEQ ID NO: 878 - DNA, 447 bp, Homo Sapiens
  Hypertrophic prostate
  sig_peptide 130..198: Von Heijne matrix
  score 5.90
  misc_feature 159..307: seq LGAAALALLLANT/DV; blastn; identity 95; region 121..269
  id W31320
  misc_feature 37..121: est; blastn; identity 95; region 1..85
  id W31320
  misc_feature 320..380: est; blastn; identity 98; region 282..342
  id W31320
  misc_feature 114..165: est; blastn; identity 94; region 77..128
  id W31320
  misc_feature 400..443: est; blastn; identity 100; region 364..407
  id W31320
  misc_feature 154..307: est; blastn; identity 100; region 2..155
  id T27259
  misc_feature 320..443: est; blastn; identity 100; region 168..291
  id T27259
  misc_feature 192..307: est; blastn; identity 93; region 108..223
  id AA157646
  misc_feature 64..95: est; blastn; identity 96; region 1..32
  id AA157646
  misc_feature 320..443: est; blastn; identity 97; region 123..246
  id AA182962
  misc_feature 198..307: est; blastn; identity 100; region 1..110
  id AA182962
  misc_feature 243..307: est; blastn; identity 100; region 189..253
  id T71690
  misc_feature 181..235: est; blastn; identity 100; region 125..179
  id T71690
  misc_feature 114..164: est; blastn; identity 94; region 58..108; id T71690; est
ccccgcccctgggaccctccgggccgggcggtttggccccttagcgcccgggcgtcggggcggtaaaaggccggcagaagggaggcacttgagaaatgtctttcctccaggacccaagttttcttcaccatggggatgtggtccattggtgcaggagccctgggggctgctgccttggcattgctgcttgccaacacagacgtgtttctgtccaagccccagaaagcggccctggagtacctggaggatatagacctgaaaacactggagaaggaaccaaggactttcaaagcaaaggagctatgggaaaaaaatggagctgtgattatggccgtgcggaggccaggctgtttcctctgtcgagaggaagctgcggatctgtcctccctgaaaagcatgttggaccagctgggcgtccccctctatgcagtggtaaaggagcaacgg

SEQ ID NO: 879 - DNA, 428 bp, Homo Sapiens
  Hypertrophic prostate
  sig_peptide 255..347: Von Heijne matrix
  score 5.90
  misc_feature 1..382: seq LPLLLVANAGTAA/VG; blastn; identity 98; region 13..394
  id C17481
  misc_feature 379..424: est; blastn; identity 95; region 390..435
  id C17481
  misc_feature 68..258: est; blastn; identity 97; region 72..262
  id T46941
  misc_feature 1..67: est; blastn; identity 100; region 6..72
  id T46941
  misc_feature complement(149..271): est; blastn; identity 92; region 1..123
  id R75331
  misc_feature 257..430: est; blastn; identity 99; region 42..215
  id W95977
  misc_feature 278..430: est; blastn; identity 99; region 5..157
  id R57521
  unsure -24: est; position -24 of amino acid sequence; Xaa = Ile,Lys,Arg
atgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagadactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaat

SEQ ID NO: 880 - DNA, 233 bp, Homo Sapiens
  Hypertrophic prostate
  sig_peptide 180..227: Von Heijne matrix
  score 5.80
  misc_feature 1..230: seq LFNLLWLALACSP/VW; blastn; identity 99; region 3..232
  id HSC1WH101
  misc_feature 102..230: est; blastn; identity 100; region 41..169
  id R12437
  misc_feature 63..104: est; blastn; identity 100; region 1..42
  id R12437
  misc_feature 63..230: est; blastn; identity 100; region 1..168
  id R13448
  misc_feature 165..212: est; blastn; identity 100; region 36..83; id T69236; est
gtttgtggccgtccggcctccctgacatgcagatttccacccagaagacagagaaggagccagtggtcatggaatgggctggggtcaaagactgggtgcctgggagctgaggcagccaccgtttcagcctggccagccctctggaccccgaggttggaccctactgtgacacacctaccatgcggacactcttcaacctcctctggcttgccctggcctgcagccctgtttgg

SEQ ID NO: 881 - DNA, 330 bp, Homo Sapiens
  Normal prostate
  sig_peptide 214..312: Von Heijne matrix
  score 5.80
  misc_feature 178..331: seq FICLQWALPHSEA/GD; blastn; identity 98; region 118..271
  id R60406
  misc_feature 178..316: est; blastn; identity 94; region 57..195
  id N78477
  est
  misc_feature 267: n=a, g, c or t
  unsure -26: position -26 of amino acid sequence
  unsure -16: Xaa = Ile,Lys; position -16 of amino acid sequence; Xaa = His,Gln
aaaggcaggactgacgcagaatgacaacggcaacacgacaagaagtccttggcctctaccgcagcattttcaggcttgcgaggaaatggcaggcgacatcagggcagatggaagacaccatcaaagaaaaacagtacatactaaatgaagccagaacgctgttccggaaaaacaaaaatctcacggacacagacctaattaaacagtgtatagatgaatgcacagccaggattgawattggactgcattacaagattccttacccanggccaattcatctgcctccaatgggccttaccccactccgaggccggggacttcgaagccaag

SEQ ID NO: 882 - DNA, 353 bp, Homo Sapiens
  Normal prostate
  sig_peptide 120..326: Von Heijne matrix
  score 5.70
  misc_feature complement(230..352): seq LCRLLCLVRLFCC/SS; blastn; identity 95; region 32..154
  id W60134
  misc_feature complement(78..189): est; blastn; identity 96; region 195..306
  id W60134
  misc_feature complement(9..87): est; blastn; identity 91; region 298..376
  id W60134
  misc_feature complement(176..352): est; blastn; identity 98; region 57..233
  id H64097
  misc_feature complement(57..189): est; blastn; identity 95; region 219..351
  id H64097
  misc_feature complement(84..352): est; blastn; identity 99; region 57..325
  id W00624
  misc_feature complement(1..70): est; blastn; identity 91; region 337..406
  id W00624
  misc_feature complement(1..168): est; blastn; identity 100; region 156..323
  id W67127
  misc_feature complement(167..323): est; blastn; identity 100; region 2..158
  id W67127
  misc_feature complement(64..352): est; blastn; identity 99; region 58..346
  id H10776
  misc_feature complement(23..64): est; blastn; identity 92; region 347..388; id H10776; est
atttggggaggggcactgtctcttttttctctcatttttaaaatgaagtgttgttgcctttgtatgtggttcaaccatccagctcccagctggctaaactttgcctccagtggtcaaagatgggaaaagagtggggttggcaggagatggaaaacggaggtgccgccccagcatggggggcaggtcccccagtccaccctgcccctccccctgtggagaagacgcttagttgggggtgtgggtttgggctccattctggattcggcggttccgggggaggggtgggtctgtgccgattactctgtcttgtacgtttgttctgctgctcttcaatattgtatcaacgccagaag

SEQ ID NO: 883 - DNA, 108 bp, Homo Sapiens
  Hypertrophic prostate
  sig_peptide 10..96: Von Heijne matrix
  score 5.70
  misc_feature 22..71: seq AALLLTATVRLSA/SP; blastn; identity 94; region 1..50
  id R82719
  misc_feature 19..62: est; blastn; identity 93; region 1..44
  id AA069083
  misc_feature 20..52: est; blastn; identity 96; region 2..34
  id R29193
  misc_feature 23..52: est; blastn; identity 96; region 10..39; id AA158081; est
aagtccaacatggcggcgcccagcggagggtggaacggcgtcggcgcgagcttgtgggccgcgctgctcctcactgccacagtcagactttcagcttctcccggccca

SEQ ID NO: 884 - DNA, 393 bp, Homo Sapiens
  Cancerous prostate
  sig_peptide 4..147: Von Heijne matrix
  score 5.70
  misc_feature 7..165: seq LLLFFGKLLVVGG/VG; blastn; identity 100; region 1..159
  id R24141
  misc_feature 178..264: est; blastn; identity 97; region 173..259
  id R24141
  misc_feature 258..299: est; blastn; identity 95; region 254..295
  id R24141
  misc_feature 230..349: est; blastn; identity 95; region 1..120
  id H25030
  unsure 32: est; position 32 of amino acid sequence; Xaa = Ile,Thr
atcatgatcgccatctacgggaagaatttctgtgtctcagccaaaaatgcgttcatgctactcatgcgaaacattgtcagggtggtcgtcctggacaaagtcacagacctgctgctgttctttgggaagctgctggtggtcggaggcgtgggggtcctgtccttcttttttttctccggtcgcatcccggggctgggtaaagactttaagagcccccacctcaactattactggctgcccaycatgacctccatcctgggggcctatgtcatcgccagyggcttcttcagcgttttcggcatgtgtgtggacacgctcttcctctgcttcctggaagacctggagcggacaacggctccctggacggccctactacatgtccaagagcttcta

SEQ ID NO: 885 - DNA, 363 bp, Homo Sapiens
  Cancerous prostate
  sig_peptide 76..348: Von Heijne matrix
  score 5.70
  misc_feature 222..265: seq SVLELIVASVCQS/HI; blastn; identity 100; region 220..263
  id N89186
  unsure -72: est
  position -72 of amino acid sequence
  unsure -53: Xaa = Glu,Gly; position -53 of amino acid sequence; Xaa = Asp,Glu,Gly
gctactttctttttcagtctttcggtgcggagaaggggaggaggcgggcagaggtctgaaaaaatcgaatgccttatggaaaggaactgcaagggttcctttggggtgatcaaagagggagacacagacacagrrgagacaaaggcaaggaggactgtctgggagccacgcgggcgatacagtttccgagrmacgccgcgtcccgcctatcctgttgaacagtgcggatttgcgaggcgcgccctggagctgctagagatccggaagcacagccccgaggtgtgcgaaccaccaaacatcccagttaccagtgtccttgaattgatagtggcttctgtttgtcagtctcatataagaactact

SEQ ID NO: 886 - DNA, 293 bp, Homo Sapiens
  Normal prostate
  sig_peptide 15..212: Von Heijne matrix
  score 5.70
  misc_feature 22..264: seq LYMLAEALPVSHG/AH; blastn; identity 100; region 1..243; id AA211459; est
gtgaagatgaagccatgtttgtagaatatagaaaacaactgaagttactgttggacaggcttgctcaagtttcaccagagttactactggcctctgttcgcagagtttttagttctacactgcagaattggcagactacacggtttatggaagttgaagtagcaataagattgctgtatatgttggcagaagctcttccagtatctcatggtgctcacttctcaggtgatgtttcaaaagctagtgctttgcaggatatgatgcgaactctggtaacatcaggagtcagcggg

SEQ ID NO: 887 - DNA, 394 bp, Homo Sapiens
  Normal prostate
  sig_peptide 326..388: Von Heijne matrix
  score 5.70
  misc_feature 155..187: seq IIFLIQWHGSVFQ/EF; blastn; identity 93; region 95..127; id H83489; est
aagtccctgtacagggtttctgacctgtggtaaaaacagaatgtcactttctgacaggcacagtacccccaggataaacttggaacctcgagaggaaattcacgaaactcgtgggggcaggggtcacaaggtgcttggtgggggaraasctggaagacatattgtccaggagaaggaatgtcacaaggaactgacaaaatcaagtcacggcgcctacaaagatgaggggcagattctggctgccttttaatttcgtccttcacctgatatctgtgccagagaatgataaaaatcataataaaggraatagyggaagaggagacttatgttactggggacatctaacataattattttcctgattcagtggcatggttcagtcttccaggagttc

SEQ ID NO: 888 - DNA, 239 bp, Homo Sapiens
  Cancerous prostate
  sig_peptide 78..137: Von Heijne matrix
  score 5.60
  misc_feature 48..238: seq AFVXACVLSLIST/IY; blastn; identity 95; region 35..225
  id HSC0CC021
  misc_feature 15..49: est; blastn; identity 94; region 1..35
  id HSC0CC021
  misc_feature 27..238: est; blastn; identity 96; region 1..212
  id T32119
  misc_feature 36..238: est; blastn; identity 97; region 1..203
  id T35494
  misc_feature 49..238: est; blastn; identity 98; region 13..202
  id HUMHG5097
  misc_feature 51..238: est; blastn; identity 98; region 1..188
  id AA027882
  unsure -19: est
  position -19 of amino acid sequence
  unsure -10: Xaa = Asp,Gly; position -10 of amino acid sequence; Xaa = Ile,Met
aagagtagggtgctgtggtctgagctagagggtgaagctggcggasaggaggatgggcgagcagtctgaatgccagaatggrtaaccgttttgctacagcatttgtaatdgcttgtgtgcttagcctcatttccaccatctacatggcagcctccattggcacagacttctggtatgaatatcgaagtccagttcaagaaaattccagtgatttgaataaaagcatctgggatgaattg

SEQ ID NO: 889 - DNA, 477 bp, Homo Sapiens
  Normal prostate
  sig_peptide 421..459: Von Heijne matrix
  score 5.60
  misc_feature complement(43..130): seq MSLTSGFLRVSQG/SP; blastn; identity 97; region 176..263
  id C01485
  misc_feature complement(137..219): est; blastn; identity 100; region 88..170; id C01485; est
caccaatgttatgaatggcgtggcctcctactgccgtccctgtgccctagaagcctctgatgtgggctcctcctgcacctcttgtcctgctggttactatattgaccgagattcaggaacctgccamtccbtgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacag

SEQ ID NO: 890 - DNA, 315 bp, Homo Sapiens
  Cancerous prostate
  sig_peptide 58..246: Von Heijne matrix
  score 5.60
  misc_feature 55..316: seq AIRTLFSVTGILA/EQ; blastn; identity 99; region 1..262
  id H87671
  misc_feature 102..261: est; blastn; identity 97; region 50..209
  id N47067
  misc_feature 55..104: est; blastn; identity 98; region 2..51
  id N47067
  misc_feature 251..316: est; blastn; identity 100; region 14..79; id AA135001; est
aacttggcgcgcggcssggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaat

SEQ ID NO: 891 - DNA, 405 bp, Homo Sapiens
  Normal prostate
  sig_peptide 187..342: Von Heijne matrix
  score 5.50
  misc_feature 89..405: seq AGLLFGSLAGLGA/YQ; blastn; identity 98; region 84..400
  id N34255
  misc_feature 5..88: est; blastn; identity 96; region 1..84
  id N34255
  misc_feature 89..304: est; blastn; identity 99; region 83..298
  id H79944
  misc_feature 8..54: est; blastn; identity 93; region 2..48
  id H79944
  misc_feature 336..382: est; blastn; identity 91; region 332..378
  id H79944
  misc_feature 304..340: est; blastn; identity 100; region 299..335
  id H79944
  misc_feature 54..88: est; blastn; identity 100; region 49..83
  id H79944
  misc_feature 109..298: est; blastn; identity 98; region 106..295
  id H73369
  misc_feature 2..88: est; blastn; identity 95; region 1..87
  id H73369
  misc_feature 336..382: est; blastn; identity 91; region 336..382
  id H73369
  misc_feature 295..326: est; blastn; identity 100; region 293..324
  id H73369
  misc_feature 164..237: est; blastn; identity 98; region 142..215
  id AA132425
  misc_feature 327..395: est; blastn; identity 95; region 307..375
  id AA132425
  misc_feature 21..88: est; blastn; identity 94; region 3..70
  id AA132425
  misc_feature 124..163: est; blastn; identity 92; region 103..142
  id AA132425
  misc_feature 109..298: est; blastn; identity 98; region 24..213
  id R97376
  misc_feature 296..405: est; blastn; identity 100; region 212..321; id R97376; est
agcaggcacaacagagccgctccccwctcctcgccccgccaccgggacggagagcgcccgccgctgcatttccggcgacacctcgcaggtcattcctgcggcttgcgcgcccttgtagacagccggggccttcgtsagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggct

SEQ ID NO: 892 - DNA, 323 bp, Homo Sapiens
  Cancerous prostate
  sig_peptide 183..287: Von Heijne matrix
  score 5.40
  misc_feature 119..237: seq CCALLTSLXCIWG/PA; blastn; identity 94; region 116..234
  id HSC2TH021
  misc_feature 25..95: est; blastn; identity 94; region 24..94
  id HSC2TH021
  misc_feature 238..289: est; blastn; identity 90; region 234..285
  id HSC2TH021
  misc_feature 280..319: est; blastn; identity 92; region 277..316
  id HSC2TH021
  misc_feature 130..237: est; blastn; identity 98; region 23..130
  id R59681
  misc_feature 238..289: est; blastn; identity 90; region 130..181
  id R59681
  misc_feature 280..325: est; blastn; identity 93; region 173..218
  id R59681
  est
  misc_feature 239..240: n=a, g, c or t
  unsure -33: position -33 of amino acid sequence
  unsure -18: Xaa = Ile,Arg
  position -18 of amino acid sequence
  unsure -17: Xaa = Asp,Gly
  position -17 of amino acid sequence
  unsure -16: Xaa = Phe,Leu
  position -16 of amino acid sequence
  unsure -15: Xaa = Cys,Phe,Gly,Ile,Leu,Arg,Ser,Val
  position -15 of amino acid sequence
  unsure -5: Xaa = Lys,Arg; position -5 of amino acid sequence; Xaa =  * ,Trp
accttctgttactgtccggggctgcggggcttgcttcckgcgtcawggctcaaagggccttcccgmatccttatgctgattataacaaatccctgdrccgaagstactttgatgctgccgggargctgactcctgagttctcacaacgcttgaccaataagattcgggagcttcttcagcaaatggagakaggcctgaaatcagcagaccctcgggatggcaccggttacactgrcttnnkcargtattgctgtgctttacttacatctttatgrtgtatttggggacctgcctacctacagttagcacatggctatgtaaag

SEQ ID NO: 893 - DNA, 240 bp, Homo Sapiens
  Normal prostate
  sig_peptide 10..135: Von Heijne matrix
  score 5.40
  misc_feature 1..241: seq ITGVILLAVGIWG/KV; blastn; identity 99; region 12..252
  id H64050
  misc_feature 1..241: est; blastn; identity 99; region 1..241
  id R17172
  misc_feature 1..241: est; blastn; identity 98; region 2..242
  id HSC15C081
  misc_feature 8..241: est; blastn; identity 99; region 1..234
  id AA149663
  misc_feature 29..241: est; blastn; identity 98; region 29..241; id HSU46380; est
gggctagtcatggcgtccccgtctcggagactgcagactaaaccagtcattacttgtttcaagagcgttctgctaatctacacttttattttctggatcactggcgttatccttcttgcagttggcatttggggcaaggtgagcctggagaattacttttctcttttaaatgagaaggccaccaatgtccccttcgtgctcattgctactggtaccgtcattattcttttgggcaccttg

SEQ ID NO: 894 - DNA, 385 bp, Homo Sapiens
  Cancerous prostate
  sig_peptide 119..319: Von Heijne matrix
  score 5.20
  misc_feature 8..349: seq LSVSLLPCAGAWS/LL; blastn; identity 96; region 6..347
  id AA075824
  misc_feature 344..385: est; blastn; identity 97; region 341..382
  id AA075824
  misc_feature 22..366: est; blastn; identity 99; region 2..346
  id R55598
  misc_feature 71..385: est; blastn; identity 99; region 1..315
  id HSC33B061
  misc_feature 156..385: est; blastn; identity 98; region 91..320
  id T65515
  misc_feature 70..141: est; blastn; identity 97; region 5..76
  id T65515
  misc_feature 29..305: est; blastn; identity 99; region 2..278
  id HSCZRF061
  est
  misc_feature 17: n=a, g, c or t
  unsure 3: position 3 of amino acid sequence
  unsure 17: Xaa = Gly,Ser; position 17 of amino acid sequence; Xaa = Pro,Thr
aaaagcggagmyaggmngggtgaggagagtcgagggaggtgacgcgcgctgccggggcgaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggatgcagactcatctgagcgtatcattgctcccatgcgctggggcttggtcccttcttrgttcaaagaaagtgatccttccaagctgcagttcaatactamcaactgtcgtagtgata

SEQ ID NO: 895 - DNA, 386 bp, Homo Sapiens
  Hypertrophic prostate
  sig_peptide 225..311: Von Heijne matrix
  score 5.10
  misc_feature 43..128: seq LLMLGVTLPNSYW/RV; blastn; identity 97; region 19..104
  id R49759
  misc_feature 132..194: est; blastn; identity 100; region 106..168
  id R49759
  est
  misc_feature 221: n=a, g, c or t
  unsure 11,14: position 11, 14 of amino acid sequence; Xaa = Ile,Asn,Thr
attcctctgacctgccaggaagcagagagacccacagagcaggcagggaggcagaaagtggagacggacctgagcccgaggaagaggcaggcagaggctgaggctgattccaccccagcctgcctggracaaaccctccttagccgcagccccttccagttccctaggggttctgcccctccccctctctggggcaccagccccccagggtcctgcatccnaccatgtcgatggctgtggaaacctttggcttcttcatggcaactgtggggctgctgatgctgggggtgactctgccaaacagctactggcgagtgtccactgtgcacgggaacgtcatcahcaccaacahcatcttcgagaacctctggtttagcagtgccggg

SEQ ID NO: 896 - DNA, 222 bp, Homo Sapiens
  Hypertrophic prostate
  sig_peptide 55..114: Von Heijne matrix
  score 5.00
  misc_feature 118..222: seq XFLXLXXLSXXWP/XD; blastn; identity 94; region 112..216
  id T86663
  misc_feature 118..156: est; blastn; identity 97; region 120..158
  id AA055880
  est
  misc_feature 90: n=a, g, c or t
  unsure -13,18: position -13, 18 of amino acid sequence
  unsure -10: Xaa = Ala,Pro
  position -10 of amino acid sequence
  unsure -8: Xaa = His,Leu,Arg
  position -8 of amino acid sequence
  unsure -7: Xaa = Ala,Val
  position -7 of amino acid sequence
  unsure -4: Xaa = Ala,Gly
  position -4 of amino acid sequence
  unsure -3: Xaa =  * ,Lys,Asn,Tyr
  position -3 of amino acid sequence
  unsure 1: Xaa = Ile,Ser
  position 1 of amino acid sequence
  unsure 10: Xaa = Ala,Gly,Pro,Arg; position 10 of amino acid sequence; Xaa = Lys,Thr
actcagaagcttggaccgcatcctagccgccgactcacacaaggcagabttgccatggagaaaattccagtgtcascattcttgcdcctngyggscctctckwasakctggccassggataccacagtcaaacctggagccamaaaggacacaaaggactctcgasccaaactgccccagaccctctccagaggttggggtgaccaactcatctggacacgg

SEQ ID NO: 897 - DNA, 366 bp, Homo Sapiens
  Normal prostate
  sig_peptide 112..312: Von Heijne matrix
  score 5.00
  misc_feature 207..326: seq LILERPLVPSAEA/SG; blastn; identity 98; region 85..204
  id W69716
  misc_feature 122..208: est; blastn; identity 97; region 1..87
  id W69716
  misc_feature 316..366: est; blastn; identity 94; region 195..245
  id W69716
  misc_feature 282..366: est; blastn; identity 100; region 94..178
  id W73842
  misc_feature 207..287: est; blastn; identity 98; region 17..97
  id W73842
  misc_feature 257..326: est; blastn; identity 94; region 42..111
  id W58108
  misc_feature 317..366: est; blastn; identity 90; region 101..150
  id W58108
  est
  misc_feature 138: n=a, g, c or t
  unsure -59: position -59 of amino acid sequence; Xaa =  * ,Tyr
ataaggcctcagggtcctgttttccctggcctcttctagagggcccgtggamcaggtcgcagtgcgtgcttatttggaaaccaggtgtgtgagccgaatgcctgccaggccatgcactcagcagaggagcccttgtanctggctgccctgagaggagcaagaggccacctcccatgtggctctagacaccacgtgggctcattagccccagcgtctgtgccggctccaggtgcctgcctctgggtgtgtgagtgggagactttgctccctggcctcatcctagagaggcccctggtgcctagtgctgaggcctctggggctggaaagctcagcagaaaggaggcactactgagcaactatgcattg

SEQ ID NO: 898 - DNA, 316 bp, Homo Sapiens
  Hypertrophic prostate
  sig_peptide 167..295: Von Heijne matrix
  score 4.90
  misc_feature 121..264: seq GLWLALVDGLVRX/AP; blastn; identity 97; region 127..270
  id N24991
  misc_feature 3..124: est; blastn; identity 95; region 10..131
  id N24991
  misc_feature 161..292: est; blastn; identity 96; region 15..146
  id HSC1WG111
  misc_feature 176..310: est; blastn; identity 97; region 1..135
  id AA001396
  misc_feature 176..265: est; blastn; identity 98; region 1..90
  id AA017578
  misc_feature 191..265: est; blastn; identity 100; region 1..75
  id R17530
  unsure -1: est
  position -1 of amino acid sequence
  unsure 6: Xaa = Arg,Thr; position 6 of amino acid sequence; Xaa = Ala,Pro
actttttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccgctgctgatcctgtcgcagatcgtcctcatgcagaccgtgtattacggctcgctgggcctgtggctggcgctggtggacgggctagtgcgaasagcccctcgctggatcscaggg

SEQ ID NO: 899 - DNA, 331 bp, Homo Sapiens
  Cancerous prostate
  sig_peptide 62..295: Von Heijne matrix
  score 4.90
  misc_feature 72..312: seq VGAVFGLTTCISA/HV; blastn; identity 97; region 76..316
  id W03477
  misc_feature 2..78: est; blastn; identity 98; region 7..83
  id W03477
  misc_feature 72..328: est; blastn; identity 97; region 69..325
  id W40364
  misc_feature 3..78: est; blastn; identity 98; region 1..76
  id W40364
  misc_feature 164..328: est; blastn; identity 100; region 172..336
  id R71313
  misc_feature 72..158: est; blastn; identity 98; region 80..166
  id R71313
  misc_feature 7..78: est; blastn; identity 94; region 16..87
  id R71313
  misc_feature 164..328: est; blastn; identity 100; region 151..315
  id H87810
  misc_feature 72..158: est; blastn; identity 98; region 59..145
  id H87810
  misc_feature 14..78: est; blastn; identity 98; region 2..66
  id H87810
  misc_feature 72..274: est; blastn; identity 97; region 52..254
  id AA135694
  misc_feature 20..78: est; blastn; identity 96; region 1..59
  id AA135694
  misc_feature 270..328: est; blastn; identity 96; region 249..307; id AA135694; est
aggctgcccttgcgcttcccgagctggcggggtccgtggtgcgggatcgagattgcgggctatggcgccgaaggtttttcgtcagtactgggatatccccgatggcaccgattgccaccgcaaagcctacagcaccaccagtattgccagcgtcgctggcctgaccgccgctgcctacagagtcacactcaatcctccgggcaccttccttgaaggagtggctaaggttggacaatacacgttcactgcagctgctgtcggggccgtgtttggcctcaccacctgcatcagcgcccatgtccgcgagaagcccgacgaccccctgaaccgg

SEQ ID NO: 900 - DNA, 215 bp, Homo Sapiens
  Cancerous prostate
  sig_peptide 150..203: Von Heijne matrix
  score 4.90
  misc_feature complement(44..183): seq WLQVLPVILLLLG/VP; blastn; identity 98; region 1..140
  id N78549
  misc_feature complement(2..34): est; blastn; identity 93; region 150..182
  id N78549
  misc_feature complement(103..214): est; blastn; identity 95; region 100..211; id N27605; est
agagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagtccccccgtcg

SEQ ID NO: 901 - DNA, 127 bp, Homo Sapiens
  Cancerous prostate
  sig_peptide 5..115: Von Heijne matrix
  score 4.80
  misc_feature complement(1..124): seq LLILDMNVLYTDA/SP; blastn; identity 100; region 59..182
  id AA045287
  misc_feature complement(1..124): est; blastn; identity 100; region 45..168
  id R77973
  misc_feature complement(1..124): est; blastn; identity 100; region 70..193
  id AA136043
  misc_feature complement(1..124): est; blastn; identity 100; region 60..183
  id AA115201
  misc_feature complement(1..124): est; blastn; identity 100; region 60..183; id R72616; est
atagatggaaatatactttatattttgtatcatcgtgcctatagccgctgccaccgtgtataaatcctggtgtctgctccttatcctggacatgaatgtattgtacactgacgcgtccccactcggg

SEQ ID NO: 902 - DNA, 220 bp, Homo Sapiens
  Hypertrophic prostate
  sig_peptide 71..163: Von Heijne matrix
  score 4.80
  misc_feature 48..140: seq VLLAIGMFFTAWF/FV; blastn; identity 91; region 36..128
  id AA054941
  misc_feature 130..197: est; blastn; identity 92; region 117..184
  id AA054941
  misc_feature 48..218: est; blastn; identity 94; region 36..206
  id W68324
  misc_feature 48..141: est; blastn; identity 91; region 22..115
  id H72703
  misc_feature 130..218: est; blastn; identity 93; region 103..191
  id H72703
  misc_feature 29..59: est; blastn; identity 93; region 4..34
  id H72703
  misc_feature 48..140: est; blastn; identity 91; region 16..108
  id AA128297
  misc_feature 130..218: est; blastn; identity 93; region 97..185
  id AA128297
  misc_feature 48..141: est; blastn; identity 91; region 13..106
  id W25240
  misc_feature 130..218: est; blastn; identity 93; region 94..182; id W25240; est
actgtcgacgtgttcttccggtggcggacggcggattagccttcgcggggcaaaattgrarcycdrggccatgagcagatataccagcccagtgaacccagctgtcttcccccatctgaccgtggtgcttttggccattggcatgttcttcaccgcctggttcttcgtttacgaggtcacctctaccaagtacactcgtgatatctataaagagctccag

SEQ ID NO: 903 - DNA, 422 bp, Homo Sapiens
  Cancerous prostate
  sig_peptide 309..413: Von Heijne matrix
  score 4.80
  misc_feature 135..179: seq LMLSSSLPLLIWL/KD; blastn; identity 91; region 15..59; id R68571; est
aactttagcctctgattgcaggccaccacttcatttacatggggtgagcaccaatgcgttttgttcaattctttgttcaaaaccccaagaatctggacaacttgcactcaagaccctctacgggtttggcgagccagtccttcagtggctgttttctagtagctccttggcaattgaggggaactggctgggaccactctccagtgctgtctgaaggccaaggagtgaacagggatggctgccctgccttgaagagggaaggactcttttctatcctttccagctatagtccctgatccctacatgtgatgcggttggcagcggaagctcatcctgggcgaactcacacacttttcaggagacttaaaccttttcttatgctaagttcttcccttcccctactcatctggctaaaggacaga

SEQ ID NO: 904 - DNA, 261 bp, Homo Sapiens
  Prostate
  sig_peptide 97..213: Von Heijne matrix
  score 4.80
  misc_feature 2..261: seq IILFSAIVGFIYG/YV; blastn; identity 93; region 17..276
  id N23506
  misc_feature 2..220: est; blastn; identity 92; region 8..226
  id R74310
  misc_feature 219..261: est; blastn; identity 100; region 226..268
  id R74310
  misc_feature 103..261: est; blastn; identity 97; region 125..283
  id N42319
  misc_feature 103..261: est; blastn; identity 97; region 119..277
  id N33735
  misc_feature 105..261: est; blastn; identity 97; region 143..299
  id R23867
  unsure -34: est
  position -34 of amino acid sequence
  unsure -19: Xaa = Gly,Ser; position -19 of amino acid sequence; Xaa = Glu,Gly
aagtgccrraccttagccctcacggtccttaagtctcggtcgccctcgcctckcagcctgccvbccgcgctcrkctgsscgactcctcagscagccatgctggagcatctgrgctcgctgcccacgcagatggattacaagggccagaagctagctgrrcagatgtttcagggrattattcttttttctgcaatagttggatttatctacgggtacgtggctgaacagttcgggtggactgtctatatagttatggccgga

SEQ ID NO: 905 - DNA, 353 bp, Homo Sapiens
  Normal prostate
  sig_peptide 297..344: Von Heijne matrix
  score 4.80
  misc_feature complement(154..354): seq SKVLFCSFSNVLG/FD; blastn; identity 97; region 70..270
  id AA164185
  misc_feature 28..111: est; blastn; identity 97; region 298..381
  id AA164184
  est
  misc_feature 275..277: n=a, g, c or t
ccaacgtgtgctttgaaaaaaagaagggatgttttctgtgtcaaatgaaggtaatcatagatcaaatttgcttattgtcttgttcaaatcctagaaaaccattagcatttttctttgcttgtaatatkagaatctaacactcatacagaatattggaaaggttaccctacaattgtaaatttgaaattctccttctaattctgtcagttatttattgacatagtagtggttctgtagtcaagtgcatataaggttttgaatgttacatcttattnnnggattwttattttatcattatggagtatagcaaagttctattttgttctttttcaaatgtacttggttttgattat

SEQ ID NO: 906 - DNA, 225 bp, Homo Sapiens
  Prostate
  sig_peptide 46..123: Von Heijne matrix
  score 4.70
  misc_feature 19..133: seq LIMQLGSVLLTRC/PF; blastn; identity 100; region 1..115
  id HSC13B041
  misc_feature 124..226: est; blastn; identity 96; region 105..207
  id HSC13B041
  misc_feature 124..226: est; blastn; identity 96; region 71..173
  id T08849
  misc_feature 53..133: est; blastn; identity 98; region 1..81
  id T08849
  misc_feature 53..135: est; blastn; identity 98; region 1..83
  id H88132
  misc_feature 124..192: est; blastn; identity 92; region 71..139
  id H88132
  misc_feature 192..226: est; blastn; identity 94; region 140..174
  id H88132
  misc_feature 53..144: est; blastn; identity 97; region 1..92
  id T33149
  misc_feature 145..226: est; blastn; identity 97; region 92..173
  id T33149
  misc_feature 52..133: est; blastn; identity 98; region 1..82
  id AA121114
  misc_feature 192..226: est; blastn; identity 94; region 141..175; id AA121114; est
actctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacagtggg

SEQ ID NO: 907 - DNA, 305 bp, Homo Sapiens
  Normal prostate
  sig_peptide 69..224: Von Heijne matrix
  score 4.70
  misc_feature 2..287: seq LGLALGRLEGGSA/RH; blastn; identity 99; region 9..294
  id W52125
  misc_feature 19..283: est; blastn; identity 100; region 1..265
  id AA024623
  misc_feature 22..284: est; blastn; identity 100; region 1..263
  id H55824
  misc_feature 21..307: est; blastn; identity 97; region 2..288
  id R62921
  misc_feature 102..287: est; blastn; identity 99; region 57..242
  id N31702
  misc_feature 45..100: est; blastn; identity 100; region 1..56; id N31702; est
attggctccggatcgtgcgtgaggcggcttcgtgggcagcgagagtcacagacaagacagcaagcaggatggagcactaccggaaagctggctctgtagagctcccagcgccttccccaatgccccagctacctcctgatacccttgagatgcgggtccgagatggcagcaaaattcgcaacctgctggggttggctctgggtcggttggagggcggcagtgctcggcatgtagtgttctcaggttctggcagggctgcaggaaaggctgtcagctgcgctgagattgtcaagcggcgggtcccg

SEQ ID NO: 908 - DNA, 322 bp, Homo Sapiens
  Hypertrophic prostate
  sig_peptide 104..181: Von Heijne matrix
  score 4.60
  misc_feature 113..324: seq LIALTCLDGTTVS/AE; blastn; identity 98; region 2..213
  id W26501
  misc_feature 111..324: est; blastn; identity 97; region 6..219
  id W28013
  misc_feature complement(211..324): est; blastn; identity 97; region 334..447
  id W28077
  misc_feature 215..324: est; blastn; identity 98; region 1..110
  id HSC3LG011
  est
  misc_feature 318: n=a, g, c or t
  unsure 46: position 46 of amino acid sequence; Xaa = Ala,Asp,Gly,Val
agcattttgcaaagatggctgtaggaatggaggagcctgtattgccgctaatgtgtgtgcctgcccacaaggcttcactggacccagctgtgaaacgacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgncgat

SEQ ID NO: 909 - DNA, 337 bp, Homo Sapiens
  Hypertrophic prostate
  sig_peptide 191..325: Von Heijne matrix
  score 4.60
  misc_feature 94..339: seq VLVYLVTAERVWS/DD; blastn; identity 97; region 62..307
  id AA133635
  misc_feature 32..97: est; blastn; identity 95; region 1..66; id AA133635; est
actcccaggctgggccagcacacccggcaggctctgtcctggaaacaggcttcaacgggcttccccgaaaaccttccccgcttctggrtatgaavwtkcaagctgcttgctgagtcctattgccggctgctgggagcmaggagagccctgaggagtagtcactcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaag

SEQ ID NO: 910 - DNA, 287 bp, Homo Sapiens
  Prostate
  sig_peptide 129..176: Von Heijne matrix
  score 4.50
  misc_feature 205..287: seq SLFIYIFXTCSNT/SP; blastn; identity 96; region 37..119
  id T82645
  est
  misc_feature 50: n=a, g, c or t
  unsure -6: position -6 of amino acid sequence
  unsure 6: Xaa = Phe,Leu
  position 6 of amino acid sequence
  unsure 35: Xaa =  * ,Gly; position 35 of amino acid sequence; Xaa = Leu,Val
actgtcccattcctccccctacaacacacacacctttcaggcagggasgngatgagcttccagccccaagagtggaggctgccacatcctaacatasgkakctattgrraaggaaksagtgtgtatctatgattatatctctgttcatctatatatttttkacatgtagcaacacctctccatcttatcaakgaactcaactcggtctgggtctccccagtgcccagtggtggcctttgacaggtaggaggatgcagtgctgcaggctattttgttttktgttacaa

SEQ ID NO: 911 - DNA, 156 bp, Homo Sapiens
  Normal prostate
  sig_peptide 61..108: Von Heijne matrix
  score 4.40
  misc_feature 1..156: seq LNSLSALAELAVG/SR; blastn; identity 98; region 40..195
  id AA227366
  misc_feature 1..156: est; blastn; identity 98; region 4..159
  id AA069390
  misc_feature 9..152: est; blastn; identity 100; region 1..144
  id AA248850
  misc_feature 18..95: est; blastn; identity 96; region 1..78
  id AA248912
  misc_feature 88..132: est; blastn; identity 93; region 70..114; id AA248912; est
atggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggcggaga

SEQ ID NO: 912 - DNA, 369 bp, Homo Sapiens
  Cancerous prostate
  sig_peptide 238..288: Von Heijne matrix
  score 4.40
  misc_feature 98..330: seq TLRTWLCCAGSWA/VE; blastn; identity 96; region 69..301
  id R99696
  misc_feature 29..98: est; blastn; identity 98; region 1..70
  id R99696
  misc_feature 206..330: est; blastn; identity 99; region 164..288
  id W90165
  misc_feature 98..209: est; blastn; identity 97; region 55..166
  id W90165
  misc_feature 43..98: est; blastn; identity 96; region 1..56
  id W90165
  misc_feature 98..330: est; blastn; identity 97; region 82..314
  id H91200
  misc_feature 16..98: est; blastn; identity 95; region 1..83
  id H91200
  misc_feature 98..249: est; blastn; identity 98; region 62..213
  id R06513
  unsure 13: est; position 13 of amino acid sequence; Xaa = Lys,Met
acatacttgcagctaraactaaatattgctgcttggggacctccttctagccttaaatttcagctcatcaccttcacctgccttggtcatggctctgsctattctccttgatccttgccatttgcaccagacctggattcctagcgtctcvatctggagtgcggctggtggggggcctccaccgctgtgaagggcgggtggaggtggaacagaaaggccagtggggcaccgtgtgtgatgacggctgggacattaaggacgtggctgtgttgtgccgggagctgggctgtggagctgccagcggaacccctagtggtattttgtawgagcaccagcagaaaaagagcaaaaggtctcatccaatcagtc

SEQ ID NO: 913 - DNA, 188 bp, Homo Sapiens
  Hypertrophic prostate
  sig_peptide 111..182: Von Heijne matrix
  score 4.30
  misc_feature complement(2..99): seq RLLVILCVSVKAG/ST; blastn; identity 97; region 99..196
  id AA088690
  misc_feature complement(87..187): est; blastn; identity 95; region 12..112; id AA088690; est
actacagcatggccacgtggaggcagcggcaggagaaaaagcagctgggcttcttctgaacccaagccctctcgactgcccctatcccctggavccccaacatacctacaatgctggggaggccctgcttccactcccctcagaggcttttggtcatcctctgcgtgtcagtaaaagcaggcagcacg

SEQ ID NO: 914 - DNA, 289 bp, Homo Sapiens
  Normal prostate
  sig_peptide 194..277: Von Heijne matrix
  score 4.20
  misc_feature 106..261: seq LQFVLPVATQIQQ/EV; blastn; identity 100; region 119..274
  id AA280906
  misc_feature 2..99: est; blastn; identity 98; region 15..112
  id AA280906
  misc_feature 260..291: est; blastn; identity 96; region 272..303
  id AA280906
  misc_feature 140..291: est; blastn; identity 99; region 224..375
  id HUM406F04B
  misc_feature 12..112: est; blastn; identity 96; region 1..101
  id HUM406F04B
  misc_feature 106..140: est; blastn; identity 100; region 94..128
  id HUM406F04B
  misc_feature 132..261: est; blastn; identity 99; region 124..253
  id AA133362
  misc_feature 5..92: est; blastn; identity 100; region 1..88
  id AA133362
  misc_feature 260..291: est; blastn; identity 96; region 251..282
  id AA133362
  misc_feature 106..261: est; blastn; identity 100; region 94..249
  id N57260
  misc_feature 10..92: est; blastn; identity 100; region 1..83
  id N57260
  misc_feature 260..291: est; blastn; identity 96; region 247..278
  id N57260
  misc_feature 41..234: est; blastn; identity 95; region 42..235
  id W25567
  misc_feature 1..40: est; blastn; identity 100; region 1..40; id W25567; est
aggggcgttgggaacggttgtaggacgtggctctttattcgtgagttttccatttacctccgctgaacctagagcttcagacgccctatggcgtccgcctcgacaccaaccggcggccttgagcgctgagcaagcaaaggtggtcctcgcggaggtgatccaggcgttctccgccccggagaatgcagtgcgcatggacgaggctcgggataacgcctgcaacgacatgggtaagatgctgcaattcgtgctgcccgtggccacgcagatccagcaggaggttatcaaa

SEQ ID NO: 915 - DNA, 355 bp, Homo Sapiens
  Normal prostate
  sig_peptide 287..349: Von Heijne matrix
  score 4.20
  misc_feature 38..69: seq LCALGSAPSSMWA/GE; blastn; identity 96; region 1..32; id H56508; est
aaacctccgtggctagtcttgacgtggcgggttgctttccaaaatggcgcgggtgctgaaggctgcagccgcdbaatgccgtaggtgaataccgggcaccgccgaccttcgccatgggacagggagcgtgggaacggcggtcgggggcggaggakgcctcggtgtggccaaagcaccttgatctaatgtcctcccccgggggcgcgttccacagcagctgctgtcacttwkggcagagggtgccttccagaagcgccaccgcttagtagcggggattgcbttgtgcatgagtcccatttccatccgagagctgtgcgccttgggctctgcaccttccagtatgtgggcbggagag

SEQ ID NO: 916 - DNA, 258 bp, Homo Sapiens
  Normal prostate
  sig_peptide 52..90: Von Heijne matrix
  score 4.20
  misc_feature 108..255: seq MTDLLSASPWALT/IV; blastn; identity 97; region 2..149
  id AA095592
  misc_feature 18..105: est; blastn; identity 98; region 219..306
  id T70757
  misc_feature 163..255: est; blastn; identity 97; region 37..129
  id H66541
  misc_feature 163..255: est; blastn; identity 97; region 37..129
  id R92835
  misc_feature 172..255: est; blastn; identity 97; region 14..97
  id H87601
  unsure 56: est; position 56 of amino acid sequence; Xaa = Arg,Trp
accaagtttgagcacctggaaagggtttatgctgacatcccctttctgttgatgacggacctcttaagtgcctcaccctgggccctcactattgtttccagtgagctccaccttgctccatccatgaccacagtggaccagctcgagtctcaagtggacaatgtkatcttacagactggagagagtgctagtgaatgcttttgtcttcaatgcccatctcttggaaatattgaaggtggagtagcaaccgggcayhgg

SEQ ID NO: 917 - DNA, 285 bp, Homo Sapiens
  Normal prostate
  sig_peptide 76..153: Von Heijne matrix
  score 4.20
  misc_feature 6..202: seq LTCGPALVPRLWA/TC; blastn; identity 98; region 10..206
  id AA074428
  misc_feature 193..254: est; blastn; identity 95; region 196..257
  id AA074428
  misc_feature 28..202: est; blastn; identity 99; region 1..175
  id AA158941
  misc_feature 193..285: est; blastn; identity 96; region 165..257
  id AA158941
  misc_feature 37..202: est; blastn; identity 98; region 1..166
  id AA148039
  misc_feature 193..254: est; blastn; identity 96; region 156..217
  id AA148039
  misc_feature 250..285: est; blastn; identity 94; region 214..249
  id AA148039
  misc_feature 74..280: est; blastn; identity 98; region 1..207; id H72224; est
aagaggctagaagctggattcagcgtgtccgcgacctcacctttaggtcctgtgagggacggcccaggtggcaggatgtcctggtctggccttctccatggcctcaacacgtccctaacttgtggcccagctctggttccccggctctgggctacctgctccatggctaccctgaaccagatgcaccgcctggggccccccaagcggccgcctcggaagctgggccccacggaaggccggccgcagctgaagggtgtggtcctgtgcacgtttacccgcaaccgg

SEQ ID NO: 918 - DNA, 225 bp, Homo Sapiens
  Cancerous prostate
  sig_peptide 25..93: Von Heijne matrix
  score 4.10
  misc_feature 18..223: seq LEAFSQAISAIQA/LR; blastn; identity 93; region 1..206
  id HSC3CC061
  misc_feature 112..223: est; blastn; identity 91; region 94..205
  id H33976
  misc_feature 49..93: est; blastn; identity 91; region 1..45
  id AA041823
  misc_feature 49..93: est; blastn; identity 93; region 1..45; id AA003782; est
aakagctgctgtggcggcggcaacatggcggacgtgataaatgtcagtgtgaacctggaggccttttcccaggccattagtgccatccaggcgctgcgatccagcgtgagcagggtgttcgactgcctgaaggatgggatgcggaacaaggagacgctggagggccgggagaaggcctttattgcgcacttccaggacaacttacattcggtcaaccgggaccca

SEQ ID NO: 919 - DNA, 339 bp, Homo Sapiens
  Cancerous prostate
  sig_peptide 109..204: Von Heijne matrix
  score 4.10
  misc_feature complement(210..340): seq RLLSSLLLTMSNN/NP; blastn; identity 99; region 172..302; id AA062591; est
agacccgatggaccccggcgacgcsccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagt

SEQ ID NO: 920 - DNA, 141 bp, Homo Sapiens
  Normal prostate
  sig_peptide 70..117: Von Heijne matrix
  score 4.10
  misc_feature complement(2..41): seq ACLAWTAVRPSAC/CH; blastn; identity 90; region 66..105; id AA085310; est
aaagtgagtttgcgaacggagcagctgctgcagcagggcccatggcggacacccagtacatcctgcccaatgacatcggcgtgtctagcctggactgccgtgaggccttccgcctgctgtcacccacagagcgccaactgg

SEQ ID NO: 921 - DNA, 290 bp, Homo Sapiens
  Hypertrophic prostate
  sig_peptide 60..224: Von Heijne matrix
  score 4.00
  misc_feature complement(147..290): seq VFGMSSSSGASNS/AP; blastn; identity 90; region 141..284
  id W12393
  misc_feature 249..289: est; blastn; identity 97; region 1..41
  id HSC2TF111
  unsure -26: est; position -26 of amino acid sequence; Xaa = Ala,Gly,Pro,Arg
atctcaacttggacttgcaatcacagaacatttaccaccatggaagagaaggaagtaggatgaatggaagtaggactctaacgcacagcattagtgatggacaacttcaaggtggccagtccaatagtgaactatttcagcaggagssacagacagcaccagctcaagttcctcaaggctttaatgtttttggaatgtccagttcctctggtgcttcaaattcagcaccacatcttggatttcacttaggcagcaaaggaacatctagcctttctcaacaaactcccggg

SEQ ID NO: 922 - DNA, 326 bp, Homo Sapiens
  Normal prostate
  sig_peptide 186..233: Von Heijne matrix
  score 4.00
  misc_feature complement(68..194): seq FFLFLSFVLMYDG/LR; blastn; identity 100; region 204..330
  id N35493
  misc_feature complement(208..323): est; blastn; identity 100; region 75..190
  id N35493
  misc_feature complement(2..79): est; blastn; identity 96; region 318..395; id N35493; est
ataaaagaagcagcaaatagaatttcccacaaagtaagttgactctaaatcttaagtattacctagttttttaaaggtttgaatataataatgcagtatttgcagtataaaaaggaaggaatttgtagagaatcattttggtgctcaagtctcttagcagtgccttattgcctcatagcaagaagatgctggggttttttttgtttttgtcctttgtattaatgtatgatggtttgcgcctttttggcattctttcaacatgtcgtgtacatcacaccatgaatcagttcctaattgatatatctagctttacctcccgagttcgg

SEQ ID NO: 923 - DNA, 383 bp, Homo Sapiens
  Hypertrophic prostate
  sig_peptide 240..320: Von Heijne matrix
  score 4.00
  misc_feature 219..380: seq SIKVLLQSALSLG/RS; blastn; identity 96; region 46..207
  id N95583
  misc_feature 219..335: est; blastn; identity 96; region 46..162
  id AA283710
  misc_feature 336..380: est; blastn; identity 100; region 162..206; id AA283710; est
agtggctcttctgacccaaggccccgccgtccaggtagggggctgtggcctctagggatcagggactacttacctgcgaatcccggttgcccgcccgccarcacgtccgktyccstaargcaramcgcctkggctcctggctgaaccgtcttctcamcgtttgscggagtctgamctccccacgcttagtccactaacgragctatccctgctcctgmcccacagcttctaagtgccagatgatggaggagcgtgccaacctgatgcacatgatgaaactcagcatcaaggtgttgctccagtcggctctgagcctgggccgcagcctggatgcggaccatgcccccttgcagcagttctttgtagtgatggagcactgctca

SEQ ID NO: 924 - DNA, 319 bp, Homo Sapiens
  Normal prostate
  sig_peptide 80..130: Von Heijne matrix
  score 3.90
  misc_feature 57..180: seq XIVSAALLAFVQT/HL; blastn; identity 97; region 15..138
  id AA090170
  misc_feature 226..286: est; blastn; identity 98; region 184..244
  id AA090170
  misc_feature 21..242: est; blastn; identity 90; region 1..222
  id HSU46267
  misc_feature 143..319: est; blastn; identity 90; region 220..396
  id AA048294
  misc_feature 149..286: est; blastn; identity 92; region 139..276
  id AA118611
  misc_feature 143..286: est; blastn; identity 92; region 88..231
  id AA063937
  unsure -13: est
  position -13 of amino acid sequence
  unsure 19: Xaa = Met,Arg
  position 19 of amino acid sequence
  unsure 47: Xaa = Leu,Arg
  position 47 of amino acid sequence
  unsure 61: Xaa =  * ,Tyr; position 61 of amino acid sequence; Xaa = Asp,Glu
agttggtggggctgggggatgagagctgcaccgcgcgggayaagtcgccggcggcgcccgamggagcagaacagagagcatggagctggagakgatcgtcagtgcagccctccttgcctttgtccagacacacctcccggaggccgacctcagtggcttggatgaggtcatcttctcctatgtgcktggggtcctggaggacctgggcccctcgggcccatcagaggagaacttcgatatggaggctttcactgagatgatggaggcctakgtgcctggcttcgcccacatccccaggggmacaataggggasatgatg

SEQ ID NO: 925 - DNA, 274 bp, Homo Sapiens
  Hypertrophic prostate
  sig_peptide 98..175: Von Heijne matrix
  score 3.90
  misc_feature 2..273: seq SLIPLFXFIGTGA/TG; blastn; identity 93; region 8..279
  id T30552
  misc_feature 3..273: est; blastn; identity 92; region 1..271
  id C14403
  misc_feature 2..273: est; blastn; identity 92; region 14..285
  id T30625
  misc_feature 4..273: est; blastn; identity 92; region 1..270
  id T32136
  misc_feature 3..270: est; blastn; identity 93; region 1..268
  id C14440
  unsure -7: est
  position -7 of amino acid sequence
  unsure 16: Xaa = Leu,Val
  position 16 of amino acid sequence
  unsure 22: Xaa = Asp,Gly
  position 22 of amino acid sequence
  unsure 29: Xaa = Asp,Gly,Asn,Ser; position 29 of amino acid sequence; Xaa = Glu,Gly,Lys,Arg
aggaagtccgtagtgtctcattgcrgataatttttagcttagggcctkgtggctaggkcggttctctcckktccagtcggagacctctgcsgvrrrcatgctccgccagatcatcggtcaggccaagaagcatccgagcttgatccccctctttktatttattggractggagctactggagcaacactgtatctcttgcgtctggcattgttcaatccagrtgtttgttgggacagarrtaacccagagccctggaacrractgggccccgaa

SEQ ID NO: 926 - DNA, 336 bp, Homo Sapiens
  Cancerous prostate
  sig_peptide 37..330: Von Heijne matrix
  score 3.80
  misc_feature 200..332: seq WTSLTCSLVVVDG/CG; blastn; identity 96; region 5..137
  id T78510
  misc_feature complement(230..332): est; blastn; identity 93; region 117..219
  id R46866
  unsure -27: est; position -27 of amino acid sequence; Xaa =  * ,Cys,Phe,Leu,Ser,Trp
aagtgcggtggagccaggcgtggaagtcgacacaagatggtgaaggagacccagtactatgacatcctgggcgtgaagcccagcgcgtccccggagagatcaagaaggcctatcggaagctggcgctcaagtaccacccggacaagaacccggatgagggcgagaagtttaaactcatatcccaggcatatgaagtgctttcagatccaaagaaaagggatgtttatgaccaaggcggagagcaggcaatbvaagaaggaggctcaggcagccccagcttctcttcacccatggacatctttgacatgttctttggtggtggtggacggatgcggg

SEQ ID NO: 927 - DNA, 397 bp, Homo Sapiens
  Normal prostate
  sig_peptide 59..166: Von Heijne matrix
  score 3.80
  misc_feature 18..194: seq RALSTXLFGSIRG/AA; blastn; identity 94; region 2..178
  id W25476
  misc_feature 206..359: est; blastn; identity 100; region 193..346
  id W25476
  misc_feature 359..396: est; blastn; identity 94; region 347..384
  id W25476
  misc_feature 21..278: est; blastn; identity 97; region 19..276
  id HUM179H07B
  misc_feature 279..379: est; blastn; identity 97; region 278..378
  id HUM179H07B
  misc_feature 17..175: est; blastn; identity 98; region 27..185
  id AA002128
  misc_feature 171..292: est; blastn; identity 99; region 182..303
  id AA002128
  misc_feature 358..396: est; blastn; identity 94; region 373..411
  id AA002128
  misc_feature 325..358: est; blastn; identity 100; region 339..372
  id AA002128
  misc_feature 204..396: est; blastn; identity 98; region 186..378
  id AA253291
  misc_feature 22..202: est; blastn; identity 95; region 5..185
  id AA253291
  misc_feature 42..260: est; blastn; identity 99; region 26..244
  id W45609
  misc_feature 251..359: est; blastn; identity 97; region 234..342
  id W45609
  misc_feature 363..396: est; blastn; identity 94; region 348..381
  id W45609
  est
  misc_feature 143,370: n=a, g, c or t
  unsure -8: position -8 of amino acid sequence
  unsure 68: Xaa = Phe,Ile,Leu,Val; position 68 of amino acid sequence; Xaa =  * ,Tyr
agtgcgcagacgcaggggtcggcgccgggtgagagcgtgcggccggattcaccacaacatggcaaatctttttataaggaaaatggtgaaccctctgctctatctcagtcgtcacacggtgaagcctcgagccctctccacanttctatttggatccattcgaggtgcagcccccgtggctgtggaacccggggcagcagtgcgctcacttctctcacccggcctcctgccccatctgctgcctgcgctggggttcaaaaacaagactgtccttaagaagcgctgcaaggactgttacctggtgaagaggcggggtcggtggtacgtctactgtaaaacccatccgaggcacaagcagagacacatgtanaccctttccctccagagtcacgcacaa

SEQ ID NO: 928 - DNA, 216 bp, Homo Sapiens
  Cancerous prostate
  sig_peptide 106..201: Von Heijne matrix
  score 3.70
  misc_feature 115..216: seq RIHLCQRSPGSQG/VR; blastn; identity 97; region 41..142
  id H64274
  misc_feature 74..116: est; blastn; identity 97; region 1..43
  id H64274
  misc_feature 115..216: est; blastn; identity 97; region 36..137
  id R16956
  misc_feature 79..116: est; blastn; identity 97; region 1..38
  id R16956
  misc_feature 123..214: est; blastn; identity 93; region 57..148
  id W04201
  misc_feature 71..124: est; blastn; identity 90; region 4..57
  id W04201
  misc_feature 123..190: est; blastn; identity 94; region 50..117
  id N76590
  misc_feature 75..116: est; blastn; identity 92; region 2..43
  id N76590
  misc_feature complement(107..195): est; blastn; identity 97; region 323..411
  id N70265
  est
  misc_feature 159: n=a, g, c or t
  unsure -23: position -23 of amino acid sequence
  unsure -15: Xaa = Phe,Val; position -15 of amino acid sequence; Xaa = Asp,Glu
accctgcctcatgcagcctatgggctaggctttagggtccgcggttggtcakaccggagcacttggcctgaagacctggaattggygacttcgatattaacaaggatggcggcggccgcagcaagtcgaggaktcggggcaaagctgggcctgcgtganattcgcatccacttatgtcagcgctcgcccggcagccagggcgtcagggacttcatt

SEQ ID NO: 929 - DNA, 295 bp, Homo Sapiens
  Cancerous prostate
  sig_peptide 101..232: Von Heijne matrix
  score 3.70
  misc_feature complement(1..279): seq IALTLIPSMLSRA/AG; blastn; identity 99; region 1..279
  id M85423
  misc_feature complement(196..289): est; blastn; identity 98; region 466..559
  id AA126476
  misc_feature complement(133..194): est; blastn; identity 98; region 560..621
  id AA126476
  misc_feature complement(105..137): est; blastn; identity 90; region 616..648
  id AA126476
  misc_feature 152..292: est; blastn; identity 100; region 1..141
  id R33928
  misc_feature 160..292: est; blastn; identity 100; region 14..146
  id H67425
  misc_feature 161..292: est; blastn; identity 100; region 1..132; id W04820; est
aacttcttcatcttggtggtccttgcccagttattttgcctcattagacatcaagaaatggagaaagactgaaagttaatatcttaagtgcttgttcttcatgtttccttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccctgcggg

SEQ ID NO: 930 - DNA, 319 bp, Homo Sapiens
  Cancerous prostate
  sig_peptide 125..304: Von Heijne matrix
  score 3.70
  misc_feature complement(9..318): seq QLXFLYFVCCIFQ/DV; blastn; identity 98; region 36..345
  id R32875
  misc_feature complement(52..318): est; blastn; identity 97; region 35..301
  id N69845
  misc_feature complement(9..52): est; blastn; identity 97; region 302..345
  id N69845
  misc_feature complement(39..318): est; blastn; identity 96; region 46..325
  id H20723
  misc_feature complement(30..318): est; blastn; identity 97; region 35..323
  id HSC3JH072
  misc_feature complement(65..318): est; blastn; identity 96; region 43..296
  id R02144
  est
  misc_feature 319: n=a, g, c or t
  unsure -56: position -56 of amino acid sequence
  unsure -11: Xaa = Asp,Glu
  position -11 of amino acid sequence
  unsure 5: Xaa = Ser,Tyr; position 5 of amino acid sequence; Xaa = Phe,Leu,Val
aamaagctcccagcctccagaggctctcaatgaagagtcaccttcatggtcgtctycaggaacaggacggatgamgaaggggtggggttaagactcaggggcacctgagggtctgagcccccttatgagtacccaagamggactgtctatgcatgcacacccacaagcctatacaccatttatatacctacacgcacgcaagagacgcggagagataggcgatgcagactcgcgattcaatgatcgatatgctcataaragtgctcaattatmttttctgtattttgtatgctgtattttccaagacgtatattatktn

SEQ ID NO: 931 - DNA, 172 bp, Homo Sapiens
  Prostate
  sig_peptide 56..118: Von Heijne matrix
  score 3.70
  misc_feature complement(1..170): seq SSCSCSLISFTRG/DK; blastn; identity 99; region 118..287
  id AA035134
  misc_feature complement(1..170): est; blastn; identity 99; region 116..285
  id N54275
  misc_feature complement(1..170): est; blastn; identity 99; region 119..288
  id AA088715
  misc_feature complement(19..170): est; blastn; identity 96; region 115..266
  id N78023
  misc_feature complement(12..133): est; blastn; identity 99; region 157..278
  id AA100730
  misc_feature complement(127..170): est; blastn; identity 90; region 119..162; id AA100730; est
atcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcagaccag

SEQ ID NO: 932 - DNA, 424 bp, Homo Sapiens
  Hypertrophic prostate
  sig_peptide 155..340: Von Heijne matrix
  score 3.70
  misc_feature complement(29..369): seq SILGIISVPLSIG/YC; blastn; identity 95; region 103..443
  id W26961
  misc_feature complement(383..424): est; blastn; identity 97; region 48..89
  id W26961
  misc_feature complement(34..369): est; blastn; identity 95; region 100..435
  id W26018
  misc_feature complement(383..424): est; blastn; identity 97; region 45..86
  id W26018
  misc_feature complement(200..369): est; blastn; identity 95; region 111..280
  id W26871
  misc_feature complement(143..200): est; blastn; identity 100; region 281..338
  id W26871
  misc_feature complement(383..424): est; blastn; identity 95; region 56..97
  id W26871
  misc_feature complement(94..123): est; blastn; identity 93; region 361..390
  id W26871
  misc_feature complement(119..369): est; blastn; identity 95; region 104..354
  id W26098
  misc_feature complement(383..424): est; blastn; identity 97; region 49..90
  id W26098
  misc_feature 31..302: est; blastn; identity 98; region 1..272
  id N99777
  misc_feature 302..369: est; blastn; identity 95; region 273..340
  id N99777
  est
  misc_feature 280: n=a, g, c or t
  unsure -46,5: position -46, 5 of amino acid sequence
  unsure -21: Xaa = Glu,Lys
  position -21 of amino acid sequence
  unsure -20: Xaa = His,Gln
  position -20 of amino acid sequence
  unsure 9: Xaa =  * ,Gly,Leu,Val
  position 9 of amino acid sequence
  unsure 14: Xaa = Arg,Trp
  position 14 of amino acid sequence
  unsure 18: Xaa = Asp,Glu,Gly,Ile,Lys,Asn,Arg,Ser,Val; position 18 of amino acid sequence; Xaa = Asp,Glu
agtgaaaagaagatgcctagagaatggcaatttaaaagaaaaagatatacttgttttgccccttgacctgaccgacactggttcccatgaagcggctaccaaagctgttctccaggagtttggtagaatcgacattctggtcaacaatggtggaatgtcccagcgttctctgtgcatggataccagcttggatgtctacagaragctaatagagcttaactacttagggacggtgtccttgacaaaatgtgttctgcctcacatgatcgagaggaagcankkaaagattgttactgtgaatagcatcctgggtatcatatctgtacctctttccattggatactgtgctagcragcatgctctshggggtttttttaatrdhcttcgaacagadcttgccacatacccaggtataatagtttct

SEQ ID NO: 933 - DNA, 441 bp, Homo Sapiens
  Cancerous prostate
  sig_peptide 82..375: Von Heijne matrix
  score 3.60
  misc_feature 179..348: seq LALRTSWISSVCS/VT; blastn; identity 96; region 160..329
  id AA159241
  misc_feature 103..184: est; blastn; identity 97; region 83..164
  id AA159241
  misc_feature 383..437: est; blastn; identity 100; region 366..420
  id AA159241
  misc_feature 21..66: est; blastn; identity 97; region 1..46
  id AA159241
  misc_feature 342..383: est; blastn; identity 95; region 324..365
  id AA159241
  misc_feature 66..102: est; blastn; identity 100; region 47..83
  id AA159241
  misc_feature 103..215: est; blastn; identity 95; region 81..193
  id AA076222
  misc_feature 216..329: est; blastn; identity 95; region 195..308
  id AA076222
  misc_feature 22..102: est; blastn; identity 97; region 1..81
  id AA076222
  misc_feature 390..437: est; blastn; identity 97; region 374..421
  id AA076222
  misc_feature 342..377: est; blastn; identity 100; region 324..359
  id AA076222
  misc_feature 241..443: est; blastn; identity 100; region 202..404
  id AA149750
  misc_feature 40..215: est; blastn; identity 96; region 1..176
  id AA149750
  misc_feature 241..443: est; blastn; identity 100; region 181..383
  id W63593
  misc_feature 63..184: est; blastn; identity 98; region 3..124
  id W63593
  misc_feature 179..243: est; blastn; identity 92; region 120..184
  id W63593
  misc_feature 320..438: est; blastn; identity 97; region 267..385
  id AA130386
  misc_feature 216..328: est; blastn; identity 98; region 164..276
  id AA130386
  misc_feature 103..215: est; blastn; identity 95; region 50..162
  id AA130386
  est
  misc_feature 214: n=a, g, c or t
  unsure -55: position -55 of amino acid sequence
  unsure -54: Xaa = Arg,Ser,Thr; position -54 of amino acid sequence; Xaa = Gly,Arg,Trp
aagtgacgcggcccaagggcggaagtgagaaagttgtctgcgtctcgaggcgagttggcggactgtgcgcgcggcggggcgatggggggctcgggcagtcgcctgtccaaggagctgctggccgartaccaggacttgacgttcctgacgaagcaggagatcctcctagcccacaggcggttttgtgagctgcttccccaggagcagcggasknggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacg

SEQ ID NO: 934 - DNA, 284 bp, Homo Sapiens
  Normal prostate
  sig_peptide 132..215: Von Heijne matrix
  score 3.60
  misc_feature 2..162: seq PLSDSWALLPASA/GV; blastn; identity 99; region 9..169
  id N76992
  misc_feature 162..280: est; blastn; identity 98; region 168..286
  id N76992
  misc_feature 2..113: est; blastn; identity 99; region 8..119
  id W39234
  misc_feature 173..280: est; blastn; identity 100; region 176..283
  id W39234
  misc_feature 113..162: est; blastn; identity 98; region 118..167
  id W39234
  misc_feature 20..160: est; blastn; identity 100; region 1..141
  id R06371
  misc_feature 193..280: est; blastn; identity 97; region 173..260
  id R06371
  misc_feature 159..195: est; blastn; identity 94; region 138..174
  id R06371
  misc_feature 20..159: est; blastn; identity 99; region 1..140
  id R06399
  misc_feature 161..280: est; blastn; identity 97; region 141..260
  id R06399
  misc_feature 27..165: est; blastn; identity 99; region 1..139
  id AA043154
  misc_feature 166..280: est; blastn; identity 99; region 141..255; id AA043154; est
aacaacttccggccccactgagcggtgtcctgagccgattacagctaggtagtggagcgccgctgcttacctgggtgcaggagacagccggagtcgctgggggagctccgcgccgccggacgcccgtgaccatgtggaggctgctggctcgcgctagtgcgccgctcctgcgggtgcccttgtcagattcctgggcactcctccccgccagtgctggcgtaaagacactgctcccagtaccaagttttgaagatgtttccattcctgaaaaacccaagctactg

SEQ ID NO: 935 - DNA, 374 bp, Homo Sapiens
  Normal prostate
  sig_peptide 6..347: Von Heijne matrix
  score 3.60
  misc_feature 169..332: seq ATFVTQALIQXYA/RI; blastn; identity 99; region 163..326
  id H71676
  misc_feature 92..170: est; blastn; identity 94; region 87..165
  id H71676
  misc_feature 20..85: est; blastn; identity 93; region 18..83
  id H71676
  misc_feature 334..364: est; blastn; identity 93; region 330..360
  id H71676
  misc_feature 264..376: est; blastn; identity 96; region 3..115
  id AA020192
  unsure -90: est
  position -90 of amino acid sequence
  unsure -89: Xaa = Ala,Gly,Ser,Thr
  position -89 of amino acid sequence
  unsure -85: Xaa = Ser,Thr
  position -85 of amino acid sequence
  unsure -21: Xaa = Glu,Gln
  position -21 of amino acid sequence
  unsure -3: Xaa =  * ,Tyr; position -3 of amino acid sequence; Xaa =  * ,Leu
aaaaaatggcggatcatgtgcagagcctggcccaactagagaatctgtgcaaacagctgtatgaaaccacagacacarscastcggagctccsaggcagagaaagcsttggttgartttaccaacagccctgattgcctgagcaagtgccagctactcctcgaaagaggaagttcctcttactcccagttactggcagctacatgccttaccaagcttgtatcacgcacaaacaaccccctaccattggaacagcgaatagatattcggaactatgtgctcaactascttgccactcggccgaagttggctactttcgtgacacaagcacttattcagtkatatgccagaatcacaaaactgggctggtttgac

SEQ ID NO: 936 - DNA, 238 bp, Homo Sapiens
  Hypertrophic prostate
  sig_peptide 62..226: Von Heijne matrix
  score 3.60
  misc_feature 15..235: seq TCSVCCYLFWLIA/IP; blastn; identity 99; region 2..222
  id H39781
  misc_feature 16..173: est; blastn; identity 100; region 1..158
  id AA017398
  misc_feature 172..235: est; blastn; identity 98; region 159..222
  id AA017398
  misc_feature 16..235: est; blastn; identity 99; region 1..220
  id AA059110
  misc_feature 17..235: est; blastn; identity 99; region 1..219
  id AA037143
  misc_feature 56..235: est; blastn; identity 99; region 56..235
  id R75754
  misc_feature 14..55: est; blastn; identity 100; region 15..56; id R75754; est
aacacttcctggtggatccgagtgaggcgacggggtaggggttggcgctcaggcggcgaccatggcgtatcacggcctcactgtgcctctcattgtgatgagcgtgttctggggcttcgtcggcttcttggtgccttggttcatccctaagggtcctaaccggggagttatcattaccatgttggtgacctgttcagtttgctgctatctcttttggctgattgcaattccggcctgg

SEQ ID NO: 937 - DNA, 437 bp, Homo Sapiens
  Cancerous prostate
  sig_peptide 54..227: Von Heijne matrix
  score 3.50
  misc_feature complement(397..432): seq GGILMGSFQGTIA/GQ; blastn; identity 97; region 283..318
  id H83411
  unsure 50,57: est; position 50, 57 of amino acid sequence; Xaa = His,Gln
atatttgccccttactttatcttgtgccttgagaaattgctggggagagaggtatgtccactgggcagctgtacaggatggaggatatagggcgtttccactcccagcagccaggttccctcaccccaagctcacccactgttggggagattatctacaataacaccagaaacacattggggtggattgggggtatccttatgggttcttttcagggaaccattgctggacaaggcacaggagccacctccatttctgagctctgcaagggacaagaactagagccatcaggggctgggctcactgtggccccaccccaagccgtcagcctccagggatcacaccctgccttggctgctacagctttttcactccastgccctaggggagttcagcasctaatgatctctatctctgaacatctcttcatccatgct

SEQ ID NO: 938 - DNA, 353 bp, Homo Sapiens
  Normal prostate
  sig_peptide 282..332: Von Heijne matrix
  score 3.50
  misc_feature 27..347: seq RWWCFHLQAEASA/HP; blastn; identity 97; region 1..321
  id T31485
  misc_feature 42..352: est; blastn; identity 99; region 1..311
  id HSC38B061
  misc_feature 135..325: est; blastn; identity 97; region 70..260
  id T66273
  misc_feature 69..140: est; blastn; identity 93; region 5..76
  id T66273
  misc_feature 2..220: est; blastn; identity 96; region 6..224
  id R24829
  misc_feature 236..275: est; blastn; identity 100; region 243..282
  id R24829
  misc_feature 50..318: est; blastn; identity 98; region 10..278; id HSC2LF071; est
ataataatatctaaaaagctaaattttaaataccagctttacataaatgattgtkgactctggtctgtktctgacacctttccagaaaaaagtcaattgttcaggtacaccaaagaggaagaagagctgtggaggccaccctctacaaagctttatagaacttctggatctaactcacaaacaagcttccagaagagactagagaccttaggccaggagatgaaggagttcagtagcaaagtcacacctgtccaattccctgagctttgctcactcagctaatgggatggcaaaggtggtggtgctttcatcttcaggcagaagcctctgcccatccccctcaagggctgcag

SEQ ID NO: 939 - DNA, 260 bp, Homo Sapiens
  Hypertrophic prostate
  sig_peptide 126..170: Von Heijne matrix
  score 3.50
  misc_feature 80..236: seq VIFFACVVRVRDG/LP; blastn; identity 95; region 34..190
  id N34164
  misc_feature 91..257: est; blastn; identity 98; region 66..232
  id R89543
  misc_feature 91..254: est; blastn; identity 98; region 66..229; id H59647; est
aggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatggactgcccctctcagcctctactgatttttaccacacccaagattttttggaatggaggagacggctcaagagtttagccttgcgactgaag

SEQ ID NO: 940 - DNA, 242 bp, Homo Sapiens
  Normal prostate
  sig_peptide 66..113: Von Heijne matrix
  score 3.50
  misc_feature 44..210: seq TALAAXTWLGVWG/VR; blastn; identity 92; region 29..195
  id R88607
  misc_feature 17..135: est; blastn; identity 96; region 16..134
  id AA035300
  misc_feature 136..244: est; blastn; identity 96; region 134..242
  id AA035300
  misc_feature 38..244: est; blastn; identity 97; region 1..207
  id AA147873
  misc_feature complement(128..244): est; blastn; identity 96; region 263..379
  id AA147836
  misc_feature complement(38..131): est; blastn; identity 94; region 375..468
  id AA147836
  misc_feature 136..244: est; blastn; identity 95; region 91..199
  id T69348
  misc_feature 45..138: est; blastn; identity 95; region 1..94
  id T69348
  unsure -8: est
  position -8 of amino acid sequence
  unsure 33: Xaa = Lys,Gln,Arg
  position 33 of amino acid sequence
  unsure 39: Xaa = Lys,Asn
  position 39 of amino acid sequence
  unsure 40: Xaa = Asp,Glu; position 40 of amino acid sequence; Xaa = Glu,Gln
aattagcgcgtaacgcasagactgcttgctgcggcagagacgccagakgtgcagctccagcagcaatggcagtgacggcgttggcggcgmrgacgtggcttggcgtgtggggcgtgaggaccatgcaagcccgaggcttcggctcggatcagtccgagaatgtcgaccggggcgcgggctccatccgggaagccggtggggccttcggaaasagagagcaggctgaagassaacgatatttc

SEQ ID NO: 941 - DNA, 402 bp, Homo Sapiens
  Normal prostate
  sig_peptide 235..288: Von Heijne matrix
  score 12.00
  misc_feature 151..402: seq FTLFLALIGGTSG/QY; blastn; identity 100; region 1..252
  id HSU21128
  misc_feature 155..402: vrt; blastn; identity 99.5999984741211; region 1..248
  id HSU18728
  misc_feature 131..402: vrt; blastn; identity 100; region 1..272
  id H27256
  misc_feature 161..402: est; blastn; identity 99; region 31..272
  id W95921
  misc_feature 296..402: est; blastn; identity 100; region 141..247
  id C17793
  misc_feature 151..252: est; blastn; identity 98; region 1..102
  id C17793
  misc_feature 174..402: est; blastn; identity 100; region 1..229
  id AA180902
  misc_feature 199..402: est; blastn; identity 98; region 1..204; id R58323; est
acatgccacaccacaagatccccacaatgacataactccattcagagactggcgtgactgggctgggtctccccaccccccccttcagctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctg

SEQ ID NO: 942 - DNA, 274 bp, Homo Sapiens
  Normal prostate
  sig_peptide 206..259: Von Heijne matrix
  score 12.00
  misc_feature 120..272: seq FTLFLALIGGTSG/QY; blastn; identity 96.0999984741211; region 1..151
  id HSU21128
  misc_feature 124..272: vrt; blastn; identity 96; region 1..147
  id HSU18728
  misc_feature 141..272: vrt; blastn; identity 97; region 40..171
  id H27256
  misc_feature 100..136: est; blastn; identity 97; region 1..37
  id H27256
  misc_feature 141..272: est; blastn; identity 97; region 40..171
  id W95921
  misc_feature 141..245: est; blastn; identity 95; region 52..156
  id AA093526
  misc_feature 89..136: est; blastn; identity 95; region 2..49
  id AA093526
  misc_feature 145..272: est; blastn; identity 98; region 1..128
  id AA180902
  misc_feature 141..223: est; blastn; identity 93; region 20..102; id C17793; est
ataactccattcagagactggcgtgactgggctgggtctccccaccccccccttcagctcttgtatcactcagaatctggcagccagttccgtcctgacagagttcacagcatatattggtggattcttgtccawaagtggvatctgctttargawttaacgaaagcagtgtcaagacagtaaggattcaaaccatttgccaaaaatgagtctaagtgcatttactctcttcctggcattgattggtggtaccagtggccagtactatgattgg

SEQ ID NO: 943 - DNA, 436 bp, Homo Sapiens
  Hypertrophic prostate
  sig_peptide 149..202: Von Heijne matrix
  score 12.00
  misc_feature 65..433: seq FTLFLALIGGTSG/QY; blastn; identity 100; region 1..369
  id HSU21128
  misc_feature 69..433: vrt; blastn; identity 99.6999969482422; region 1..365
  id HSU18728
  misc_feature 45..433: vrt; blastn; identity 99; region 1..389
  id H27256
  misc_feature 75..433: est; blastn; identity 99; region 31..389
  id W95921
  misc_feature 210..433: est; blastn; identity 99; region 141..364
  id C17793
  misc_feature 65..166: est; blastn; identity 98; region 1..102
  id C17793
  misc_feature 88..433: est; blastn; identity 100; region 1..346
  id AA180902
  misc_feature 113..370: est; blastn; identity 98; region 1..258; id R58323; est
agctcttgtatcactcagaatctggcagccagttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcggg

SEQ ID NO: 944 - DNA, 423 bp, Homo Sapiens
  Normal prostate
  sig_peptide 91..150: Von Heijne matrix
  score 8.90
  misc_feature 75..345: seq LLLLLLPFLLYMA/AP; blastn; identity 96.3000030517578; region 1..269
  id HUMD3A07M5
  misc_feature 51..159: vrt; blastn; identity 99; region 1..109
  id AA121593
  est
  misc_feature 305..307,363: n=a, g, c or t
  unsure 50: position 50 of amino acid sequence
  unsure 52: Xaa = Leu,Val
  position 52 of amino acid sequence
  unsure 53: Xaa =  * ,Cys,Phe,Leu,Ser,Trp,Tyr
  position 53 of amino acid sequence
  unsure 63: Xaa = Gly,Arg,Trp
  position 63 of amino acid sequence
  unsure 71: Xaa = Lys,Arg
  position 71 of amino acid sequence
  unsure 72: Xaa = Lys,Asn
  position 72 of amino acid sequence
  unsure 78: Xaa = Glu,Gln; position 78 of amino acid sequence; Xaa = Glu,Lys
aatttgaattggggcgtgtctagaaagagaagccatagtcggcgagcaacgctggagcatcccgctctggtgccgctgcagccggcagagatggttgagctcatgttcccgctgttgctcctccttctgcccttccttctgtatatggctgcgccccaaatcaggaaaatgctgtccagtggggtgtgtacatcaactgttcagcttcctgggaaagtagttgtggtcacaggagctaatacaggtatcgggaaggagacagccaaagagctggctcagagaggagctcgagtatatktagcttnnngggatgtggaaaagggggaattggtggccaragagatccagaccacgacagggaansagcaggtgttggtgcggraactggacctgtctgatactaagtctattcgagcttttgct

SEQ ID NO: 945 - DNA, 306 bp, Homo Sapiens
  Normal prostate
  sig_peptide 184..228: Von Heijne matrix
  score 8.10
  misc_feature 132..303: seq LLYLLVPALFCRA/GG; blastn; identity 96; region 1..171
  id HSC1R
  misc_feature 143..303: vrt; blastn; identity 98; region 24..183
  id HUMC1R
  misc_feature 181..303: vrt; blastn; identity 92; region 1..123
  id T74375
  misc_feature 170..213: est; blastn; identity 93; region 1..44; id T64778; est
aaaaactcagatcttttgtttatgcaaatagttcattccctccaacattcctccgggaatggtcccccctccactccacagaaaaccctcccctccctgctgtgcatgacgcgggctccctctgsacacagkgvmcraagacgctgtcgggakagccccaggattcaacacgggccttgagaaatgtggctcttgtacctcctggtgccggccctgttctgcagggcaggaggctccattcccatccctcagaagttatttggggaggtgacttcccctctgttccccaagccttaccccaacggg

SEQ ID NO: 946 - DNA, 263 bp, Homo Sapiens
  Normal prostate
  sig_peptide 51..146: Von Heijne matrix
  score 7.70
  misc_feature 50..263: seq LLFLVAGLLPSFP/AN; blastn; identity 99; region 1..214
  id HSSPG28
  misc_feature 75..263: vrt; blastn; identity 99; region 1..189; id HSCRISP3G; vrt
aatatatacggctctaaccttctctctctgcaccttccttctgtcaatagatgaaacaaatacttcatcctgctctggaaaccactgcaatgacattattcccagtgctgttgttcctggttgctgggctgcttccatcttttccagcaaatgaagataaggatcccgcttttactgctttgttaaccacccaaacacaagtgcaaagggagattgtgaataagcacaatgaactgaggagagcagtatctccccctgccaaa

SEQ ID NO: 947 - DNA, 465 bp, Homo Sapiens
  Cancerous prostate
  sig_peptide 52..102: Von Heijne matrix
  score 6.90
  misc_feature 133..467: seq LFLTMLTLALVKS/QD; blastn; identity 97; region 1..335
  id HSU03877
  misc_feature 213..467: vrt; blastn; identity 94; region 232..486
  id AA150097
  misc_feature 35..204: est; blastn; identity 99; region 55..224
  id AA150097
  misc_feature 43..467: est; blastn; identity 98; region 56..480
  id AA155808
  misc_feature 43..404: est; blastn; identity 97; region 73..434
  id AA147966
  misc_feature 395..467: est; blastn; identity 97; region 424..496
  id AA147966
  misc_feature 51..467: est; blastn; identity 98; region 1..417
  id AA058479
  misc_feature 70..405: est; blastn; identity 97; region 1..336
  id W46890
  misc_feature 394..425: est; blastn; identity 100; region 326..357
  id W46890
  est
  misc_feature 34,365,392..393: n=a, g, c or t
  unsure 88: position 88 of amino acid sequence
  unsure 94: Xaa = Ala,Cys,Asp,Phe,Gly,Ile,Asn,Ser,Thr,Val,Tyr
  position 94 of amino acid sequence
  unsure 97: Xaa = Ala,Gly,Val; position 97 of amino acid sequence; Xaa = His,Ile,Lys,Leu,Met,Asn,Pro,Gln,Arg,Ser,Thr
aactcccctcgctgcccgggcccggagcgcassnggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccdncagcatggcaaccagtgbagtgttgmnngggggtggttttgtggccagtgctgctgcagtcgcaggccctgaaatgcagactggccggaataactttgtc

SEQ ID NO: 948 - DNA, 256 bp, Homo Sapiens
  Normal prostate
  sig_peptide 50..115: Von Heijne matrix
  score 5.90
  misc_feature 50..256: seq LLILWFHLDCVSS/IL; blastn; identity 96; region 1..204
  id HUMTCAYV
  misc_feature 50..256: vrt; blastn; identity 93; region 1..207
  id MACTCRAAQ
  misc_feature 50..256: vrt; blastn; identity 94; region 1..204; id MACTCRAAR; vrt
aattttggctgcaaaacgtttttctgctgtgggtacgtgagcaggaaacatggagaagaatcctttggcagccccattactaatcctctggtttcatcttgactgcgtgagcagcatactgaacgtggaacaaagtcctcagtcactgcatgttcaggagggagacagcaccaatttcacctgcagcttcccttccagcaatttttatgccttacactggtacagatgggaaactgcaaaaagccccgaggccgtg

SEQ ID NO: 949 - DNA, 455 bp, Homo Sapiens
  Hypertrophic prostate
  sig_peptide 345..389: Von Heijne matrix
  score 5.30
  misc_feature 62..455: seq VVTIVILLCFCKA/AE; blastn; identity 98.6999969482422; region 1..392
  id HSU32907
  misc_feature 138..415: vrt; blastn; identity 99; region 1..278
  id H09504
  misc_feature 410..454: est; blastn; identity 91; region 274..318
  id H09504
  misc_feature 160..455: est; blastn; identity 99; region 1..296
  id H17686
  misc_feature 128..329: est; blastn; identity 94; region 42..243
  id AA247900
  misc_feature 85..123: est; blastn; identity 94; region 1..39
  id AA247900
  misc_feature 318..355: est; blastn; identity 97; region 231..268
  id AA247900
  misc_feature 128..231: est; blastn; identity 96; region 22..125
  id R57541
  misc_feature 231..274: est; blastn; identity 97; region 124..167
  id R57541
  misc_feature 312..455: est; blastn; identity 99; region 1..144
  id N87278
  est
  misc_feature 276: n=a, g, c or t
agctggggccatgtaatttaaaacctctgaaaagtgtgctgcggtccgtgcacagcattagtataacgtgagggctgaatgcagcccattctctggagaacttcctcacacaccgcagcmaargagaaggmctgaaagacaaacctgggtgcagccagagaggtccagatagatgagcttgtggcatccattccccaagttcagcctagggactccacgtaccccagctgggtctcattgttccagaactgcattagttaagattacccagacttngatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtgga

SEQ ID NO: 950 - DNA, 437 bp, Homo Sapiens
  Normal prostate
  sig_peptide 132..401: Von Heijne matrix
  score 5.10
  misc_feature 45..438: seq LLFVATLPFWTHY/LI; blastn; identity 100; region 1..394
  id HSU20350
  misc_feature 87..438: vrt; blastn; identity 99; region 3..352; id HSU28934; vrt
aaactctgcaaataaaatgctcttagagggaaggaaagggaaatactcgtctctggtaaagtctgagcaggacagggtggctgactggcagatccagaggttcccttggcagtccacgccaggccttcaccatggatcagttccctgaatcagtgacagaaaactttgagtacgatgatttggctgaggcctgttatattggggacatcgtggtctttgggactgtgttcctgtccatattctactccgtcatctttgccattggcctggtgggaaatttgttggtagtgtttgccctcaccaacagcaagaagcccaagagtgtcaccgacatttacctcctgaacctggccttgtctgatctgctgtttgtagccactttgcccttctggactcactatttgataaatgaaaagggcctccacaatgccatgtgc

SEQ ID NO: 951 - DNA, 464 bp, Homo Sapiens
  Testis
  sig_peptide 90..179: Von Heijne matrix
  score 13.20
  seq LLLLSTLVIPSAA/AP
  misc_feature 411..412: n=a, g, c or t
  unsure 73: position 73 of amino acid sequence
  unsure 78: Xaa = His,Asn; position 78 of amino acid sequence; Xaa =  * ,Ala,Glu,Gly,Lys,Leu,Met,Pro,Gln,Arg,Ser,Thr,Val,Trp
aaaacagtacgtgggcggccggaatccgggagtccggtgacccgggctgtggtctagcataaaggcggagccagaagaaggggcggggtatgggagaagcctccccacctgcccccgcaaggcggcatctgctggtcctgctgctgctcctctctaccctggtgatcccctccgctgcagctcctatccatgatgctgacgcccaagagagctccttgggtctcacaggcctccagagcctactccaaggcttcagccgacttttcctgaaaggtaacctgcttcggggcatagacagcttattctctgcccccatggacttccggggcctccctgggaactaccacaaagaggagaaccaggagcaccagctggggaacaacaccctctccagcmacctccagatcgacnngatgaccgacaacaagacaggagaggtgctgatctccgagaatgtggtggca

SEQ ID NO: 952 - DNA, 199 bp, Homo Sapiens
  Testis
  sig_peptide 56..118: Von Heijne matrix; score 12.00; seq VLVLCVLLLQAQG/GY
aagggaagtctgtgactgcctggccagacttagggctcacgctctggtcagagttatggcaccccagactctgctgcctgtcctggttctctgtgtgctgctgctgcaggcccagggaggataccgtgacaagatgaggatgcagagaatcaaggtctgtgagaagcgacccagcatagatctatgcatccaccacagg

SEQ ID NO: 953 - DNA, 349 bp, Homo Sapiens
  Testis
  sig_peptide 47..103: Von Heijne matrix
  score 11.00
  unsure 46: seq SLVLLLCLTCSYA/FM; position 46 of amino acid sequence; Xaa = Phe,Val
aaagcaaacccgtcatgagcaactcccttccccatctctgttcaccatgtggacgctgaaatcgtccctggtcctgcttctgtgcctcacctgcagctatgcctttatgttctcttctctgagacagaaaactagcgaaccccaggggaaggtgcaatacggagagcactttcggattcggcagaatctaccagagcacacccaaggctggcttgggagcaaatggctctggcttcttkttgttgttgtgccgtttgtgatactgcagtgtcaaagagacagtgagaagaataaggagcagagtcctcctggccttcgaggcggccaacttcactctccattaaagaaa

SEQ ID NO: 954 - DNA, 414 bp, Homo Sapiens
  Testis
  sig_peptide 70..117: Von Heijne matrix
  score 10.60
  unsure 92: seq LLLLPLLWGGSLQ/EK; position 92 of amino acid sequence; Xaa = Ala,Pro
aaattttggagcatttccttccctgacagccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatsccagaatggaggacacgggcggg

SEQ ID NO: 955 - DNA, 215 bp, Homo Sapiens
  Ovary
  sig_peptide 24..101: Von Heijne matrix
  score 10.40
  seq LLLLLCGPSQDQC/RP
  misc_feature 3: n=a, g, c or t
aanccagctgcsgccggccagccatggagactggagcgctgcggcgcccgcaacttctcccgttgctgctgctgctctgcggcccttcccaggatcaatgccgacctgtactccagaatctgttgcagagcccaggcttgacatggagcttggaagtgcccactgggagagaaggaaaggaaggtactatgagagtttcaccaactgcaccaagg

SEQ ID NO: 956 - DNA, 297 bp, Homo Sapiens
  Testis
  sig_peptide 49..96: Von Heijne matrix; score 10.10; seq LVLTLCTLPLAVA/SA
aaagatccctgcagcccggcaggagagaaggctgagccttctggcgtcatggagaggctcgtcctaaccctgtgcaccctcccgctggctgtggcgtctgctggctgcgccacgacgccagctcgcaacctgagctgctaccagtgcttcaaggtcagcagctggacggagtgcccgcccacctggtgcagcccgctggaccaagtctgcatctccaacgaggtggtcgtctcttttaaatggagtgtacgcgtcctgctcagcaaacgctgtgctcccagatgtcccaactcaggg

SEQ ID NO: 957 - DNA, 421 bp, Homo Sapiens
  Testis
  sig_peptide 62..130: Von Heijne matrix
  score 9.80
  unsure 15: seq FLLFFFLFLLTRG/SL
  position 15 of amino acid sequence
  unsure 16: Xaa = Ala,Cys,Gly,Ser,Trp
  position 16 of amino acid sequence
  unsure 17: Xaa = Cys,Gly; position 17 of amino acid sequence; Xaa = Ile,Met
acatggtcggygtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggagctcaaggagkskkgcatsgggaaccaggactgcgagactggctgctgccaacgtgctccagacaattgcgagtcgcactgcgcggagaaggggtccgagggcagtctgtgtcaaacgcaggtgttctttggccaatatagagcgtgtccctgcctgcggaacctgacttgtatatattcaaagaatgagaaatggcttagcatcgcctatggccgttgtcagaaaattggaaggcagaagttggctagraaatgttct

SEQ ID NO: 958 - DNA, 151 bp, Homo Sapiens
  Testis
  sig_peptide 68..133: Von Heijne matrix
  score 9.80
  unsure -14: seq LVVFCLALQLVPG/SP; position -14 of amino acid sequence; Xaa = Phe,Tyr
aaacagcagtgcctggtcaaacccagcaacccttggccagaacttactcacccatcccactgacaccatgaagcctgtgctgcctctccagtwcctggtggtgttctgcctagcactgcagctggtgcctgggagtcccaagcagctaggg

SEQ ID NO: 959 - DNA, 253 bp, Homo Sapiens
  Spleen
  sig_peptide 134..238: Von Heijne matrix
  score 9.50
  unsure 5: seq LFFSLFSAPLASA/VR; position 5 of amino acid sequence; Xaa = Arg,Thr
aaacagatactcccagcacatgttccawagcagccccctgatccaattttccttagcacgtaggctcaagacaatgccccacttcccaaaggccttgtggcaatgtcctctttttctttcacatatatgatttatgttccgtcaacgacaggaaactgctcaaagatccacccagtcctgccgctgcccccgtgatggtttgtttttctcattgtttagcgctccattagcttccgcagtgagagccgccasg

SEQ ID NO: 960 - DNA, 124 bp, Homo Sapiens
  Ovary
  sig_peptide 14..91: Von Heijne matrix; score 9.40; seq RLLLALPLALVLG/FE
agtaccacaggcaatggggtcaagtgcctgtgaaatagctgtcgggactaaaaggttattattagctctgcctctcgctcttgttctgggctttgaaggctcatcagttcccccaagaaatttt

SEQ ID NO: 961 - DNA, 353 bp, Homo Sapiens
  Testis
  sig_peptide 186..254: Von Heijne matrix
  score 9.40
  unsure 9: seq SLLFICFFGESFC/IC
  position 9 of amino acid sequence
  unsure 11: Xaa =  * ,Lys,Leu,Met; position 11 of amino acid sequence; Xaa =  * ,Glu,Gly
aatattttgctgactggcaaggttatatgaagtgcttttattgaagcaccattttaactaatagctcctggtattttctgcttcccttcgtagggaatttagttattttattttattatttagctaatttagctattttaaaatagctaaattttagctacttttttttcaattgacaaagaaggatgtctaatcaaagactaccgctgattttttctctgttgtttatctgcttcttcggggagagtttctgcatttgtgatggaactgtctggacawwggttkratgggagattcttccagaagaagtacattattggaaagttaagggttctccatctcactgcctgcgg

SEQ ID NO: 962 - DNA, 167 bp, Homo Sapiens
  Ovary
  sig_peptide 108..155: Von Heijne matrix; score 9.20; seq FLSFLLALLSLNC/IP
acatggagtttacaaaatttatattatcatgaaatacttcaatagagggttgggaaatctaactctggaggaaatgccacaaatttccactgctggggtttttgaagatgctctggttcctatcttttcttctagctctcctttccctcaattgtatccccatcggg

SEQ ID NO: 963 - DNA, 203 bp, Homo Sapiens
  Testis
  sig_peptide 84..155: Von Heijne matrix
  score 9.20
  unsure -22: seq ICCVIVLISLSWT/SP
  position -22 of amino acid sequence
  unsure -16: Xaa = Cys,Phe; position -16 of amino acid sequence; Xaa = Phe,Val
atgtkcgaatttattgctgagactttccagtgcattttgcatctctctgagtgtgtccttgatttccaaaagttgttttatttatgctgtktatttcactcgagattktttccttcatatgctgtgtcattgttttgatttctttaagttggacttcacctttcactggtgtgtacttgattggtttaataatcgagccaggg

SEQ ID NO: 964 - DNA, 266 bp, Homo Sapiens
  Ovary
  sig_peptide 183..239: Von Heijne matrix; score 9.20; seq ILFILTFFSHTFC/SR
aatttcactgatgtctagctgtggctctctttttatacctcctatttaataccacatggtctttgaaacctggagacttactgatttcttgagctctagtaaatgttcttttctcatttaattgatcattttctcccatttgttgtctccttacatccccagggcattactattttgtagctatggtattcaggaactgcattttatttattttaacttttttttctcatactttctgtagtaggcagaataaagcccagccctgg

SEQ ID NO: 965 - DNA, 159 bp, Homo Sapiens
  Ovary
  sig_peptide 7..45: Von Heijne matrix; score 9.10; seq MLAACPLSPGCQS/AP
gacggcatgctggctgcgtgtcccctctcaccaggttgccaaagcgctccatcaacgtggaatcattttcctcctgaaagaataaccactggagccggcagccttctgaaaccagggggtggcctctggccacgcacagtctctctgccctcccctgcg

SEQ ID NO: 966 - DNA, 270 bp, Homo Sapiens
  Spleen
  sig_peptide 43..99: Von Heijne matrix; score 9.10; seq FLTLITHCTVSWA/QS
aagctgcgggtagagaagacaggactcaggacaatctccagcatggcctggtcccctctcttcctcaccctcatcactcactgtacagtgtcctgggcccagtctgttctgactcagccaccctcggtgtctgaagcccccagacagagggtcaccatctcctgttttggaagcagctccaatatcggacgaaatgctgtaaactggtatcagcaactcccaggaaggtctcccagacttctcattttttataataatctcccggcatcg

SEQ ID NO: 967 - DNA, 111 bp, Homo Sapiens
  Testis
  sig_peptide 49..102: Von Heijne matrix; score 9.10; seq LVSLCSWSPPLTS/SP
acaggcatagatctagccccaccatcaagacaaacaacattttctattatgttaaaaagtgtccttgtaagcctttgcagttggtctcctcccctgacttccagccccagg

SEQ ID NO: 968 - DNA, 285 bp, Homo Sapiens
  Testis
  sig_peptide 154..219: Von Heijne matrix
  score 9.00
  seq FILAALSLSTTFS/LQ
  misc_feature 168: n=a, g, c or t
  unsure -18: position -18 of amino acid sequence; Xaa = Phe,Leu
aakaccctccctcccgttgctccaaactaatacggactgaacggatcgctgcgagggtgggagagaaaattagggggagaaaggacagakagakcaactaccatccatagccagatagattatcttacactgaactgatcaagtactktgaaaatgacttcgaaattnatcttggtgtccttcatacttgctgcactgagtctttcaaccaccttttctctccaaccataccagcaraaggttctactagtttcttttgatggattccgttgggattacttatat

SEQ ID NO: 969 - DNA, 123 bp, Homo Sapiens
  Ovary
  sig_peptide 52..111: Von Heijne matrix
  score 8.90
  misc_feature 85..120: seq LAVXLGLATAVSA/GP; blastn; identity 100; region 44..79
  id AA280744
  unsure -14: est
  position -14 of amino acid sequence
  unsure -10: Xaa = Ile,Leu; position -10 of amino acid sequence; Xaa = Ala,Asp
gaaagtgaaaggaggaagaggaggctaaatggctgaggaggtcgcagcgccatgaagtccctgtctctvmtcctmgctgtggmtttgggcctggcgaccgccgtctcagcaggacccgcgtgg

SEQ ID NO: 970 - DNA, 345 bp, Homo Sapiens
  Ovary
  sig_peptide 106..168: Von Heijne matrix; score 8.80; seq LLWALLFMQSLWP/QL
aaagatactgactgaacatggctggcggactcaggctggggtctgcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacaagaaccggatagggggaactacaagaagaccatgg

SEQ ID NO: 971 - DNA, 246 bp, Homo Sapiens
  Testis
  sig_peptide 100..159: Von Heijne matrix
  score 8.80
  unsure -14: seq LLVMGSLPSASWS/LP; position -14 of amino acid sequence; Xaa = Phe,Leu
acggtgcagggcagagaaggagcagccttggactggggatcctgagtagtcctgtctgggaatggagggcactgaattggcaccctccttggaggccacatggcccaaacatgggcattdctgctggtgatgggatctctcccttctgccagctggtctctgccctgtttgagctgggaaagtttgctgaaggctgcagcctgttctgagttggatggtagaaatgtaggaaatacaccaactcgg

SEQ ID NO: 972 - DNA, 201 bp, Homo Sapiens
  Ovary
  sig_peptide 130..195: Von Heijne matrix; score 8.70; seq LITLLYVWPVINA/CQ
atgaatgagtgttaataggcaattttaaaggacagaacctctggggaaccatcctgcagttctccatgtgtacttaagttgattttggaaaccagaaacatatackacttccttagaagttctacattgatgaaatgtgggtttctggcttacttgctaatcacactcttgtatgtttggccagttattaatgcttgccag

SEQ ID NO: 973 - DNA, 128 bp, Homo Sapiens
  Testis
  sig_peptide 21..95: Von Heijne matrix; score 8.50; seq LKVLLLPLAPAAA/QD
agggcggatcttctccggccatgaggaagccagccgctggcttccttccctcactcctgaaggtgctgctcctgcctctggcacctgccgcagcccaggattcgactcaggcctccactccaggcagg

SEQ ID NO: 974 - DNA, 313 bp, Homo Sapiens
  Spleen
  sig_peptide 152..202: Von Heijne matrix
  score 8.40
  unsure 37: seq LLFLTSVVPFVLA/PR; position 37 of amino acid sequence; Xaa = Pro,Arg
aagaatcttcccagtaggcggcgcgggagggaaaagaggattgaggggctaggccgggcggatcccgtcctcccccgatgtgagcagttttccgaaaccccgtcaggcgaaggctgcccagagaggtggagtcggtagcggggccgggaacatgaggcagtctctcctattcctgaccagcgtggttcctttcgtgctggcgccgcgacctccggatgacccgggcttcggcccccaccagagactcgagaagcttgattctttgctctcagactacgatattctctctttatctaatatccagcagcagcsg

SEQ ID NO: 975 - DNA, 142 bp, Homo Sapiens
  Ovary
  sig_peptide 29..103: Von Heijne matrix; score 8.10; seq SVLLGLLALMATA/AV
aagctgaggtggcagtggttccaccaacatggagctctcgcagatgtcggagctcatggggctgtcggtgttgcttgggctgctggccctgatggcgacggcggcggtagcgcgggggtggctgcgcgcgggggaggtgagg

SEQ ID NO: 976 - DNA, 358 bp, Homo Sapiens
  Testis
  sig_peptide 50..244: Von Heijne matrix
  score 8.00
  unsure 20: seq LTLIGCLVTGVES/KI
  position 20 of amino acid sequence
  unsure 27: Xaa = Leu,Pro; position 27 of amino acid sequence; Xaa = Lys,Asn
aaggaaaggattactcgagccttgttagaatcagacatggcttcaggggatgcaggacgctcccctgagctgcctgtcaccgactaagtggagcagtgtttcttccgcagactcaactgagaagtcagcctctgcggcaggcaccaggaatctgccttttcagttctgtctccggcaggctttgaggatgaaggctgcgggcattctgaccctcattggctgcctggtcacaggcgtcgagtccaaaatctacactcgttgcaaactggcaaaaatattctcgagggctggcctggacaatcygaggggcttcagccttggaaastggatctgcatggcgtattatgagagcggctgg

SEQ ID NO: 977 - DNA, 419 bp, Homo Sapiens
  Spleen
  sig_peptide 24..311: Von Heijne matrix; score 7.60; seq ALCGLCLLCPRAA/RV
atttctcctggcaccctgtattcatggccttggcgttctgcctctgcatggctgaagccatcctactcttctcacctgaacactccctgttcttcttctgctcccgaaaagcacggatccggctccactgggcagggcagaccctagccatcctctgtgcagctctgggcctgggcttcatcatctccagcaggacccgcagtgagctgcctcatctggtgtcctggcacagctgggtgggagccctgacactgctggccactgctgtccaggcactgtgtgggctctgcctcctttgtccccgggcagccagggtctcaagggtggctcgcctcaagctctaccatctgacatgtggactggtggtctacctgatggctacagtaacggtgcttctgggcatgtactcagtatggttc

SEQ ID NO: 978 - DNA, 336 bp, Homo Sapiens
  Spleen
  sig_peptide 37..207: Von Heijne matrix
  score 7.50
  unsure -47: seq LLHRLASFHRVWS/FP
  position -47 of amino acid sequence
  unsure -44: Xaa = Phe,Val
  position -44 of amino acid sequence
  unsure -42: Xaa = Met,Val
  position -42 of amino acid sequence
  unsure -33: Xaa = Asp,Glu
  position -33 of amino acid sequence
  unsure -27: Xaa = Phe,Tyr
  position -27 of amino acid sequence
  unsure -24: Xaa = Lys,Asn
  position -24 of amino acid sequence
  unsure -22: Xaa = Leu,Arg
  position -22 of amino acid sequence
  unsure 9: Xaa = Ala,Gly; position 9 of amino acid sequence; Xaa = Ile,Lys,Met,Asn
aagkctgccggtggggactcttgcagggccgtccccatgttrcgttttccgacctgtttcccatccktccgggtgrtgggagakaagcagctcccgcaggagattatttwcctggtctggtcgcccaakcgggatckcattgstttggccaacacagctggcgaggttttacttcatcgactggcaagttttcatcgagtttggagttttccaccaaatgaaaatacaggaawkgaggtgacgtgtctggcatggagaccagatggcaaacttttggcctttgctcttgctgataccaagaaaattgttttgtgtgatgtagaaaaacctgagagc

SEQ ID NO: 979 - DNA, 398 bp, Homo Sapiens
  Spleen
  sig_peptide 9..134: Von Heijne matrix
  score 7.50
  seq LALVVALVAERFA/RR
  misc_feature 301: n=a, g, c or t
  unsure 56: position 56 of amino acid sequence
  unsure 62: Xaa = His,Leu,Pro,Arg; position 62 of amino acid sequence; Xaa = Pro,Arg
agaccttcatgttcatggtgctggaggtggtggtgagccgggtgacctcgtcgctggcgatgctctccgactccttccacatgctgtcggacgtgctggcgctggtggtggcgctggtggccgagcgcttcgcccggcggacccacgccacccagaagaacacgttcggctggatccgagccgaggtaatgggggctctggtgaacgccatcttcctgactggcctctgtttcgcgatcctgctggaggccatcgagcgcttcatcgagccgcacgagatgcagcagccgctggtggtscnttggggtcgggcgtggcsggctgctggtcaacgtgctggggctctgcctcttccaccatcacagcggcttcagccaggactccggccgcggccatgg

SEQ ID NO: 980 - DNA, 306 bp, Homo Sapiens
  Testis
  sig_peptide 70..186: Von Heijne matrix; score 7.50; seq LLLLLGLIVLVNI/GI
aastgtgssttggggccgggggtggggggcagaggggggtggcccaggtggccctaggaccccccctccatggaaaaccagctatggcataacaccgtgagatgttgcaatcaataccaagaaagcccccacgatgccgaggacatcttactcctgctgctgggcctcatcgttcttgtcaacattggcatcaacgtggcaactatgatgtggcatggactccagaacgccttagacaagatgattgattgggctactcagaaaatagcagtcttcttcgctgtgttcgtcgccgccgccgcccgg

SEQ ID NO: 981 - DNA, 178 bp, Homo Sapiens
  Ovary
  sig_peptide 23..76: Von Heijne matrix
  score 7.50
  unsure -15: seq ITLLTLSPNSVCC/CP; position -15 of amino acid sequence; Xaa = Ile,Arg,Ser
aatactgaggtatattgccaaaatgctctccakwaagatcaccctcttgacactgtcacccaatagtgtgtgttgctgcccctcagcaaccctgggtgccagcaatcattctcatctttggagatctactagcagacatggcatctccttcccatgggcattccttttaattaacggg

SEQ ID NO: 982 - DNA, 234 bp, Homo Sapiens
  Testis
  sig_peptide 79..132: Von Heijne matrix
  score 7.40
  unsure 20: seq GWLVLCVLAISLA/SM; position 20 of amino acid sequence; Xaa = Lys,Arg,Thr
ctgctgggcagcccacagggtccctgggcggagggcaggagcatccmgttggagttgacaacaggaggcagaggcatcatggagggtccccggggatggctggtgctctgtgtgctggccatatcgctggcctctatggtgaccgaggacttgtgccgagcaccagacgggaagaaaggggaggcaggvavacctggcagacgggggcggccaggcctcaagggggagcaacgg

SEQ ID NO: 983 - DNA, 364 bp, Homo Sapiens
  Testis
  sig_peptide 41..100: Von Heijne matrix; score 7.30; seq LAVFMLLAQLVSG/NW
aatagagacttctggactctatagaacccactgcctcctgatgaagtccctactgttcacccttgcagtttttatgctcctggcccaattggtctcaggtaattggtatgtgaaaaagtgtctaaacgacgttggaatttgcaagaagaagtgcaaacctgaagagatgcatgtaaagaatggttgggcaatgtgcggcaaacaaagggactgctgtgttccagctgacagacgtgctaattatcctgttttctgtgtccagacaaagactacaagaatttcaacagtcacagcaacaacagcaacaacaactttgatgatgactactgcttcgatgtcttcgatggctcctacccgtttctcc

SEQ ID NO: 984 - DNA, 62 bp, Homo Sapiens
  Ovary
  sig_peptide 9..56: Von Heijne matrix; score 7.30; seq LILLFSLLISIVC/MI
atagtaaaatgttaaagttgatcttacttttttcgctcctcatctctattgtttgtatgatt

SEQ ID NO: 985 - DNA, 296 bp, Homo Sapiens
  Testis
  sig_peptide 195..272: Von Heijne matrix; score 7.10; seq LASLQWSLTLAWC/GS
aaagtgtagaacacggacctctgagttatgctcttgagaggtgccaaagctgggctgtttacctaccttatccacagagctctgaaagtcaagccagaaaggaaggattccaaattcttggaattttatctagaaaagaagactaagcagcttttgttcttctgtgacccagttgctggcccaagacatggacaatgaccccctggtgtttggcgtgtctggggaggaggcctctcgcttctttgcagtggagcctgacactggcgtggtgtggctccggcagccactggacagag

SEQ ID NO: 986 - DNA, 315 bp, Homo Sapiens
  Spleen
  sig_peptide 151..228: Von Heijne matrix; score 6.90; seq LWVLLLCAHVVTL/LV
aacacgcagctagacacagctamcttgagtcttggagctcctagagggamgcttctggamaggaaggctcttcaggacctcttaggagccagagmmsmggacgtksacacagataaagagccaggctcaccagctcctgacgcatgcaksatgaccatgagacacaactggacaccagacctcagccctttgtgggtcctgctcctgtgtgcccacgtcgtcactctcctggtcagagccacacctgtctcgcagaccaccacagctgccactgcctcagttagaagcacaaaggacccctgcccctcccagcgg

SEQ ID NO: 987 - DNA, 131 bp, Homo Sapiens
  Testis
  sig_peptide 27..86: Von Heijne matrix; score 6.90; seq LFCATLSCMPATS/AP
aagcctactttgacactcatttaaagatgacagggaacaatagagatttgttctgtgcaaccctttcttgtatgccggcgacatcagctccgcacatgaaactgcccgatatttcattccacctgcccggg

SEQ ID NO: 988 - DNA, 224 bp, Homo Sapiens
  Ovary
  sig_peptide 114..191: Von Heijne matrix; score 6.90; seq LWVLLLCAHVVTL/LV
acttcccagaagcagctctggtgctgaagagagcactgcctccctgtgtgactggagaagaggacgttgtcacagataaagagccaggctcaccagctcctgacgcatgcatcatgaccatgagacacaactggacaccagacctcagccctttgtgggtcctgctcctgtgtgcccacgtcgtcactctcctggtcagagccacacctgtctcgcagcccacg

SEQ ID NO: 989 - DNA, 333 bp, Homo Sapiens
  Testis
  sig_peptide 79..138: Von Heijne matrix; score 6.90; seq LYLLGMLVPGGLG/YD
acttgatgcattcattctcaaggacacttgatccactgccagagaggcccagaattttctaacttactgtgtggcagaatgaagcctctgcttgaaaccctttatcttttggggatgctggttcctggagggctgggatatgatagatccttagcccaacacagacaagagattgtggacaagtcagtgagtccatggagcctggagacgtattcctataacatataccaccccatgggagagatctatgagtggatgagagagatcagtgagaagtacaaggaagtggtgacacagcatttcctaggagtgacctatgagacccaacccgcg

SEQ ID NO: 990 - DNA, 295 bp, Homo Sapiens
  Spleen
  sig_peptide 80..274: Von Heijne matrix; score 6.80; seq LLFLISLAAHLSQ/WT
aaagtattggggatgctgagctgcggggtacgggcctgaggagggatgggagtaagaagtgctgtggaaaccgtcagccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggtcggagcggg

SEQ ID NO: 991 - DNA, 451 bp, Homo Sapiens
  Spleen
  sig_peptide 317..442: Von Heijne matrix; score 6.80; seq LLSILSSLTMVIC/RH
actacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttctgagcattttatccagtctcaccatggtgatttgcagacacggg

SEQ ID NO: 992 - DNA, 317 bp, Homo Sapiens
  Testis
  sig_peptide 162..290: Von Heijne matrix
  score 6.80
  unsure -9: seq ALSAXTFVSFLHA/AP; position -9 of amino acid sequence; Xaa = Ala,Pro
agtacggatctctttaatattctgtgtaacaaaatagaaatgctcataaagtacttctgcggcaaaccaaagtatagcacctgactcaaggaaaagcaaggaaaagcacatgtgggatcccttgaatggcaagtgaaactagccactagtttcatttttacatgaaacaatggctgtgttgggtgctgaggctggaaggtagacaggggcttggggttggagagcctcgtgggctgcgtttgtgcttgggggccttgagcgcasccacctttgtcagctttctacacgctgctccccactcccatccagcccttggg

SEQ ID NO: 993 - DNA, 235 bp, Homo Sapiens
  Ovary
  sig_peptide 29..226: Von Heijne matrix; score 6.80; seq LLFFLFPILFIRS/QH
acaatttgggtgtgtctggtgtyttgccatgagactggggttatgcttctgggtgccacacagaggtgaaatgtccttctcatcacattattcgagaggtacatggtaccaatgggacttatcgctgctgatgttaaccttgatctcttggttcaggtggtgcctgccagctgtctccactgtggagttactatttttccttttccccattttattcatcagaagccagcaccgg

SEQ ID NO: 994 - DNA, 390 bp, Homo Sapiens
  Ovary
  sig_peptide 67..369: Von Heijne matrix; score 6.60; seq IIIVITITSACSA/CI
actttctaagagtacttgtttagatattttgtgtccctagatttgtctgatgattaggctgcagttatggatttttgggaagaataccgcagaggtgatgtgcccttctcatggtgtcctatcaggagctacctgatgtcagtatgtcctgttactggcaaagttaaccttaatcatttggttaaggtagcctctgccaggtttctccaccaagttactatttttccttttctgtactctgttaaggcaaattattgctttttaaattttgatgtacctcaatatgcatgggagatacatagctttgcagctccctcaatcttaattgtaataataatagtaataacaataactagcgcttgctccgcctgcatagttctaaacacatgt

SEQ ID NO: 995 - DNA, 349 bp, Homo Sapiens
  Testis
  sig_peptide 59..139: Von Heijne matrix; score 6.50; seq SLSLSTVWNWIQA/SF
aatatttagattcctgaagcttctgcacatgtagttcctagagctgctgcttattaaaatgtcaacatcttcatcttctagctgggacaacctcttagagtctctctctctcagcacagtatggaattggatacaagcaagttttttgggagagactagtgcacctcagcaaacaagtttgggactattagataatcttgctccagctgtgcaaatcatcttgaggatttctttcttgattttattgggaataggaatatatgccttatggaaacgaagtattcagtcaattcagaaaacattgttgtttgtaatcacactctacaaactttacaagaagggctcggcg

SEQ ID NO: 996 - DNA, 302 bp, Homo Sapiens
  Spleen
  sig_peptide 27..104: Von Heijne matrix
  score 6.50
  unsure 41: seq LALGSAGLLWCLA/GF; position 41 of amino acid sequence; Xaa = Asp,Asn
agcagaccggccgccgcttcaccggcatggtcttcgccaccatcggtttctcgctgaagtcgggcctggcccttggctcggcgggcctgctgtggtgcctggccggtttcttcggctacgacacacagcagcccacggcacccaacgccatcgagggctaccgcgtcatgtccagcttcggcgtcggcgcgctgttcgccgcctgcacgatctgcctgctggcsracaagctgaacaagcagacgacgctgaagatggccgacgacctcgcccaacggcgccagcaggccgaccttgcgccg

SEQ ID NO: 997 - DNA, 151 bp, Homo Sapiens
  Testis
  sig_peptide 35..76: Von Heijne matrix; score 6.40; seq VLLLSGSVSVGVC/CA
acaatctcacagtccgtggcagagccttgtcctgatggttttattgctttctggcagtgtgagtgtgggtgtgtgttgtgcctacttgtgcatctccatttctaaaacaccaactgcttgtgcattgtatggtctttatttaccgtttttt

SEQ ID NO: 998 - DNA, 169 bp, Homo Sapiens
  Uterus
  sig_peptide 26..112: Von Heijne matrix
  score 6.40
  unsure -10: seq GLCXLCXVXNVFA/GS
  position -10 of amino acid sequence
  unsure -7: Xaa = Lys,Arg
  position -7 of amino acid sequence
  unsure -5: Xaa = Phe,Leu; position -5 of amino acid sequence; Xaa = Asn,Thr
ataatctgtaactttagccccaaccatgtgctcgcagaaacgtgctgtatcaaatcaaggtttaatggatttagggctgtgcargctgtgcyttgttamcaatgtgtttgcaggcagtatgcctggtaaaagtcattgccattctccattctctattaaccagggcagg

SEQ ID NO: 999 - DNA, 157 bp, Homo Sapiens
  Ovary
  sig_peptide 29..70: Von Heijne matrix; score 6.40; seq LIVLTLHSPSCDT/AQ
atgggggtttctttgttgctgctgggtgatgctaatagtcctgactctccactcgccctcctgtgacactgcccaggaggagatggggagggtgcccactactcccaagtgcaggtggaagttagggctctccatgtgttctttgctgacacctggg

SEQ ID NO: 1000 - DNA, 437 bp, Homo Sapiens
  Testis
  sig_peptide 66..251: Von Heijne matrix; score 6.40; seq SVLWLGALGLTIQ/AV
aactcccagaatgctgaccaaagtgggaggagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggcccgcagtcacactctgccacagcgcaaacttctcaccaggggccagagtcagggggccggtgaaggtcctggacagcaggaggctctactcctgcaaatgggtacagtct

SEQ ID NO: 1001 - DNA, 237 bp, Homo Sapiens
  Uterus
  sig_peptide 133..177: Von Heijne matrix; score 6.40; seq LTCLFLSLISTYP/SC
atttatggtagagagatatatttgtattggttccagttccattggtttgtgaaatattaatatgccaacacagcctagcatattggagtcactggaaatgcatcagtgctagccttacatgcctttcactctatggtgttaacctgcctttttctaagtctaatctccacttaccccagctgtatcacactttttctttccaaaattcctaatcctctgtcttcactcccctcactg

SEQ ID NO: 1002 - DNA, 281 bp, Homo Sapiens
  Testis
  sig_peptide 171..224: Von Heijne matrix
  score 6.30
  unsure 16: seq FSFSLQLLSSSST/NP; position 16 of amino acid sequence; Xaa = Leu,Val
atctgtctcttgtttattaagatatgcacagtttctgaatcaacaaatatatctgtgattcttttatactactacataaaagaacagggrgtaattcttgccttataaattaaatgtcaaacatttcctatatgtaatcatttgttcctaaaatatgatttagtcccagcatgcttatccctgttttctctttttctctccagctcctatctagttcttcaacaaatcctgtcaactctaccttccaaatgccttttgaatccagccatstcaccaccaga

SEQ ID NO: 1003 - DNA, 206 bp, Homo Sapiens
  Spleen
  sig_peptide 15..155: Von Heijne matrix
  score 6.30
  seq LLLLESVSGLLQP/RT
  misc_feature 28: n=a, g, c or t
  unsure -43: position -43 of amino acid sequence; Xaa = Cys,Phe,Ser,Tyr
aaacccgggggaagatggcggcagcgtntctgagtgggccctctgcgggctccgcggctggggttcctggcgggaccgggggtctctcggcagtragctcgggcccgcggctccgcctgctgctgctggagagtgtttctggtttgctgcaacctcgaacggggtctgccgttgctccggtgcatcccccaaaccgctcggcaagg

SEQ ID NO: 1004 - DNA, 140 bp, Homo Sapiens
  Ovary
  sig_peptide 78..122: Von Heijne matrix; score 6.20; seq NWLFLFVFTFCNC/FF
catcttgtacatctgtkagcatgtatctgtgaacatatccataggctggatacctagcaggtcaaaatgacgtgtgcatgcataattggctttttttgtttgtwtttactttttgtaactgcttttttaaaaataatggc

SEQ ID NO: 1005 - DNA, 352 bp, Homo Sapiens
  Uterus
  sig_peptide 245..295: Von Heijne matrix; score 6.20; seq CFYFLSTALGSQA/DS
actaccaatggaaaatgcagctcttgaggatgacgattgccaaacaaaggctcggagacgaagcaatcggcgtgcgacactttgcagcccatgagcgtgaagacttggtgcagcagctagagcgagctaaggaacaggttctcactaacatctattcagagtgggggatgcatttgcacagctggacacaacacaaacaagagtggactgtgcccctcgtttctcagagtatggggtgcctgggatgcacgttgaatgcttttacttcctcagcactgcactagggtcccaagctgactcttgggtttctggcctccagcaggcaggtctgctccctgctattgggtaccgg

SEQ ID NO: 1006 - DNA, 353 bp, Homo Sapiens
  Ovary
  sig_peptide 177..233: Von Heijne matrix; score 6.10; seq LALLWSLPASDLG/RS
ataagtgaaccagaccaccctgatggcatccacagtgatgtcaaggttggggctggccaggggtgggtggactagaagcatttgggagtagtggccaggggccctggacgctagccacggagctgctgcacagagcctggtgtccacaagcttccaggttggggttggagcctgggatgagccccggcagcgccttggcccttctgtggtccctgccagcctctgacctgggccggtcagtcattgctggactctggccacacactggcgttctcatccacttggaaacaagccagtcttttctgcaaggtcagttgaccaagagcatatttcccctctgttgtacatcgttg

SEQ ID NO: 1007 - DNA, 290 bp, Homo Sapiens
  Spleen
  sig_peptide 180..218: Von Heijne matrix; score 6.10; seq MALALGSIPSSIA/SS
acaaggtcatgaggctgaattaggctttgtgtgctccttctaggttctcagcgtctgtctggtcctttacttgctttagatctctgccccagccactgtaggcaggaacagctctcttccttgagaactcaagaggttctcaaggtagtaaacttcatggtgctcttagtttagtctgaatggccttggccttggggtccatcccaagttccatagccagcagttgggtccatgtctcacatttttgtccctgtctcctccacacaacattgccacagtccaccccgaag

SEQ ID NO: 1008 - DNA, 108 bp, Homo Sapiens
  Ovary
  sig_peptide 31..78: Von Heijne matrix; score 6.10; seq FLFCTLFSLVVHP/SH
aatagttcacatatttatgtttttccacaaatgctagcatttttgttctgcactctgttttctttagtagtgcatccttcacacatagatttaaaatgctcattttat

SEQ ID NO: 1009 - DNA, 349 bp, Homo Sapiens
  Spleen
  sig_peptide 32..139: Von Heijne matrix
  score 6.00
  unsure 45: seq LLYTLQTISSLSG/CF
  position 45 of amino acid sequence
  unsure 46: Xaa = Leu,Pro
  position 46 of amino acid sequence
  unsure 52: Xaa =  * ,Leu
  position 52 of amino acid sequence
  unsure 55,57,60: Xaa = Phe,Leu
  position 55, 57, 60 of amino acid sequence
  unsure 56: Xaa = Pro,Ser
  position 56 of amino acid sequence
  unsure 59: Xaa =  * ,Lys; position 59 of amino acid sequence; Xaa = Gly,Arg
aggtgcaggggaggtaaggtgggagcaggtcatggctcaaatgccactgacaggctcttaccaagatttagaatattttcttgaatgcatgtttctccatttattatatactcttcaaacaatttccagtttaagtggttgttttaaacaattttttttccagttaaattgtttttgttggggagaaattctatggcactcttcattcctccattctggaagttgtctcttggttttgctcattaaaaaaaaaaagatatatcttcaatctcyctwaatctatacaggttacttwatagatyctwaayctttasgtyccttctccatccctttaagtttcatacagttt

SEQ ID NO: 1010 - DNA, 150 bp, Homo Sapiens
  Ovary
  sig_peptide 91..135: Von Heijne matrix; score 6.00; seq LLMGLWVRTVLQG/KE
aataaagcatacagaaacccacctaaaatagactcagggaggtaggaggtttcctaagggctgagactgaaagataatagggattgcttgatggcattgttgatggggctgtgggtgagaacagtgctccagggaaaagaggccagcggg

SEQ ID NO: 1011 - DNA, 180 bp, Homo Sapiens
  Uterus
  sig_peptide 100..156: Von Heijne matrix
  score 6.00
  unsure -8: seq LAILIXSLKLTIG/IQ; position -8 of amino acid sequence; Xaa = Phe,Val
attaaagttggagagagattagaggcagaattaacagaaaggagatgtgagaatccagtagtcatttaattttaaaaaacaggtattcaataaaattttatgattaaccatttatatttggctattcttattktttctttaaaattaacaataggaatccagaaacgtttcggaccaccg

SEQ ID NO: 1012 - DNA, 218 bp, Homo Sapiens
  Ovary
  sig_peptide 12..161: Von Heijne matrix; score 6.00; seq LLYLCSFPLPGTS/LF
aaaacaaaattatgggtaggcaagggactttagaaattgagggcattctctgtgtcatcacttggttagaggcaaatctagggaaacaaaaagatgagaatcactactataagaaattatcccttttatacctttgctcatttccactgcctggaacgtccctttttcttctctgctctttctcatatcttactcaaagactttcccaaggtggaggg

SEQ ID NO: 1013 - DNA, 394 bp, Homo Sapiens
  Testis
  sig_peptide 173..289: Von Heijne matrix; score 5.90; seq SAWWCVLLEWSQG/AS
actggggaaattgagcctaagagaacagaaagtacttgaggtcccacaatgaatctatggatgaatgagtgcttattcattcactcattttttaaaaaaatccattccacaagtatgtcttaatcactgcagtgtaaggcacatagggacaaaatagaagattcctgtcctcatggaactcacaaacaagcaaacaggaactgacagacatgaacaggtactacggagggtaaagcaagacaagaggataagtgcatggtggtgcgttttactggagtggtcacagggggcctctctgaggaggcaacatcgaggggagacaagccccaaatctggggaaagactttccaggcagagagaacagcaaaaaccgcagatgagtgacaagagcctg

SEQ ID NO: 1014 - DNA, 213 bp, Homo Sapiens
  Testis
  sig_peptide 4..69: Von Heijne matrix
  score 5.90
  unsure 21: seq VLGLLFSISDTWA/PA
  position 21 of amino acid sequence
  unsure 22: Xaa =  * ,Ile,Lys,Leu
  position 22 of amino acid sequence
  unsure 28: Xaa =  * ,Lys; position 28 of amino acid sequence; Xaa = Asp,Glu
acaatggccaagcgtcaaaatcctacgtcagtgctaggactgcttttttctatatcagacacgtgggctcctgctgtgtcttcctggaaagcagaggccaaggatggagcagaccaagaggatgccaggwwawaatcacaaagaagcccagawagcacagctggaagccaagaaccctatttttggtttgtgtgggtggaaggtgagggacgg

SEQ ID NO: 1015 - DNA, 375 bp, Homo Sapiens
  Testis
  sig_peptide 250..324: Von Heijne matrix
  score 5.90
  unsure 3: seq FCLSLQIFRVSLA/LA
  position 3 of amino acid sequence
  unsure 15: Xaa = His,Gln; position 15 of amino acid sequence; Xaa = Glu,Lys
ataaggctagttctattttgaagcctatgtgttttgtgaaacacaaaaaaaagtacagagaaagatcgcatccttttctggtaggggttttcaggaaaaagtaagagttctgactcatgttgggatttcttgggccgttattctgcagtggtcaaaatgggggaagcatgtctgtaaaagtgttactgatatgactaacactaactgatctactttcaaacattacctttttcctctccctccctgtttatgaatgttttgcccttctcttactattatatcttgttttgtttgagtttacaaattttcagagtttccctagctctggcacasactcatgaggttcctgtctctactcatactaacraattgcat

SEQ ID NO: 1016 - DNA, 190 bp, Homo Sapiens
  Ovary
  sig_peptide 17..103: Von Heijne matrix
  score 5.90
  seq FSYISXFLSPVCG/CS
  misc_feature 181: n=a, g, c or t
  unsure -8: position -8 of amino acid sequence
  unsure 26: Xaa = Cys,Gly; position 26 of amino acid sequence; Xaa = Phe,Leu
atcaaaattctctttgatgaaatgtttaaaagtgaacccttttttatttctggtwtttaatttcttttcctacatcagtkgctttttgtcaccagtatgtggatgttctgtctgtaatttaaaacactgggagaatgagcttctatttccttctccccactttttgccatataaatttttntttcttttt

SEQ ID NO: 1017 - DNA, 226 bp, Homo Sapiens
  Testis
  sig_peptide 74..172: Von Heijne matrix
  score 5.80
  unsure -13: seq XLCLGMALCPRQA/TR; position -13 of amino acid sequence; Xaa = Phe,Val
atctcttggcgtctcaacgttcggatcagcagcttttttccattctctctctccacttcttcagtgagcagccatgagttggactgtgcctgttgtgcgggccagccagagagtgagctcggtgggagcgaatktcctatgcctggggatggccctgtgtccgcgtcaagcaacgcgcatcccgctcaacggcacctggctcttcacccccgtgagcaagatggcg

SEQ ID NO: 1018 - DNA, 173 bp, Homo Sapiens
  Ovary
  sig_peptide 111..155: Von Heijne matrix
  score 5.80
  unsure -11: seq FLXLMTLTTHVHS/SA; position -11 of amino acid sequence; Xaa = Cys,Ser
atccgatacagaacatgcagtaatgtggactgcccaccagaagcaggtgatttccgagctcagcaatgctcagctcataatgatgtcaagcaccatggccagttttatgaatgggyttcctgwgtctaatgaccctgacaacccatgttcactcaagtgccaagccaaatggg

SEQ ID NO: 1019 - DNA, 98 bp, Homo Sapiens
  Ovary
  sig_peptide 33..80: Von Heijne matrix; score 5.70; seq RVLLLAQLFLGSG/KT
aaattctctgggcctgcttgtcatcactccagatgttgtttagagttcttctgttagcacagctgtttctagggtctggaaaaactctaaggaccccg

SEQ ID NO: 1020 - DNA, 243 bp, Homo Sapiens
  Ovary
  sig_peptide 79..174: Von Heijne matrix; score 5.70; seq SLPLSTSAPPLRG/LR
aacagtcctgccggctggcttgggtgggtggtgggctgcgggtaggggaggggatggaccgagtcccggcttgtcgggatgagggttccggaagatctggccagtaagattctactccctggctgtgcaccgggttccctacccctgtctacgtcggctccgccacttcgcggcttgagactaaaagagcatcccggcagggggccttccagccccaaagcagcctgtccagagacccccgcg

SEQ ID NO: 1021 - DNA, 182 bp, Homo Sapiens
  Ovary
  sig_peptide 63..155: Von Heijne matrix
  score 5.70
  unsure -27: seq SDLCLCQCILARA/HD; position -27 of amino acid sequence; Xaa = Arg,Ser
acatttctaacgagtactgcccaatcatttggtagaatgccccttaactttgggttwgtttgatgtttcctcacagwgaractcaggttaagtgtttttggcagggattacgcagaagcgatctgtgtctgtgtcaatgcatcctagcaagggcacatgatggcgatttatacctttttttt

SEQ ID NO: 1022 - DNA, 272 bp, Homo Sapiens
  Testis
  sig_peptide 81..140: Von Heijne matrix
  score 5.60
  seq LAVFMXLAQLVSG/NW
  misc_feature 169..170,187: n=a, g, c or t
  unsure -8: position -8 of amino acid sequence
  unsure 10: Xaa = Leu,Arg
  position 10 of amino acid sequence
  unsure 16: Xaa = Ala,Asp,Glu,Gly,Val
  position 16 of amino acid sequence
  unsure 30: Xaa = Lys,Met,Arg,Thr; position 30 of amino acid sequence; Xaa = Ala,Pro
aaaagaaggacaataaagatctgtgttcagagtcatactgaatagagacttctggactctatagaacccactgcctcctgatgaagtccctactgttcacccttgcagtttttatgckcctggcccaattggtctcaggtaattggtatgtgaaaaagtgtctaaacgnntttggaatttgcaagangaagtgcaaacctgaagagatgcatgtaaagaatggttggscaatgtgcggcaaacaaagggactgctgtgttccagctaacggg

SEQ ID NO: 1023 - DNA, 161 bp, Homo Sapiens
  Testis
  sig_peptide 18..86: Von Heijne matrix; score 5.60; seq LLNVACCIPFSSS/LF
attttccaaacattgtgatgcacctttatagctgttcgtgtatgcgccttttaaacgtggcatgctgcatacccttttcgagcagcctgtttccgcacattcttttcaagtcattaaactattccttgacgtcctttctcaaggctgtgcgtggccggtgg

SEQ ID NO: 1024 - DNA, 285 bp, Homo Sapiens
  Testis
  sig_peptide 223..270: Von Heijne matrix; score 5.50; seq PLVLSPLSYQCSS/QG
aatgtttaagatctgttttaaatttaaaacaatgaattgaatgctctaagaggctcctacaggcgctccaggccactctcagagactcccaggagttgttgaactatatttggagaaaacagccamtgaatattatcatttctcctttaaagagagtttgtaaggggggaacatgcattttatcagacaatttatccaaagcatttcagaacatgagtgctgatgagggcacctcttgtgctgagtcccctcagctatcagtgttcttctcaaggacacatttgg

SEQ ID NO: 1025 - DNA, 262 bp, Homo Sapiens
  Testis
  sig_peptide 146..253: Von Heijne matrix
  score 5.50
  unsure -24: seq FTSMCILFHCLLS/FQ; position -24 of amino acid sequence; Xaa = Ile,Lys
aacttgggacaagaratcaaactttaaagatggtctaaagcccctcttaaaggtctgactgtgtcggacctctagagctaatctcactagatgtgagccattgtttatattctagccatcctttcatttcattctagaagaccccatgcaagttccccacctaagggtctggacacaggtgawagataccttcattggttatagaaatttgggatttacaagtatgtgcatattgttccactgtcttcttagctttcagagg

SEQ ID NO: 1026 - DNA, 183 bp, Homo Sapiens
  Testis
  sig_peptide 46..153: Von Heijne matrix; score 5.40; seq LWLMHQSFQKSNS/SS
actacgaatgcagatgtggaaacaacttctgtgcatctcatcgttatgcagaaactcatggctgtacctatgattacaagagcgcagggaggagatacttgcacgaggcaaatcctgtggttaatgcaccaaagcttccaaaaatctaactcttcctctacatcttactgttctgcccagggg

SEQ ID NO: 1027 - DNA, 162 bp, Homo Sapiens
  Ovary
  sig_peptide 1..135: Von Heijne matrix
  score 5.40
  seq AHRSLCLWPACLC/AR
  misc_feature 162: n=a, g, c or t
  unsure -43: position -43 of amino acid sequence
  unsure -39: Xaa = Ile,Val
  position -39 of amino acid sequence
  unsure -15: Xaa = Asn,Tyr; position -15 of amino acid sequence; Xaa = Leu,Pro
atgtgtrtagctgggtttwatgaccaccctcgtgcggcccggcacgcccgcacgtcccgccaccccctcccttgggtgtgtgtctctcagcyccctgcacaccgttccctatgtctgtggcccgcgtgcctbtgtgcgcgtgtgctccccccagcgccaggn

SEQ ID NO: 1028 - DNA, 127 bp, Homo Sapiens
  Testis
  sig_peptide 62..115: Von Heijne matrix; score 5.40; seq ILVSFILAALSLS/TT
atcggactgaacggatcgctgcgaggattatcttacactgaactgatcaagtactttgaaaatgacttcgaaatttatcttggtgtccttcatacttgctgcactgagtctttcaaccaccataggg

SEQ ID NO: 1029 - DNA, 332 bp, Homo Sapiens
  Ovary
  sig_peptide 279..323: Von Heijne matrix; score 5.40; seq LLIFILTVHHTPS/LP
atcttttgtttgagtatcttcaagaaaaatctgttgtgagaaagatcctaaacatatgtatgtatagatgcatatctttgaaagcctatgtgaataccaagggaatctgaactttttctttggagatgtttacataataaatctattttcatcaatctggcatatttttctcctagcactgacttactgaatgccgctgaccacgtgctgcctctcatgctaaatgcttacttaattcatcaccaaattctgtagactgtacaggctaaacacctctaatgcatttacttattttcatcctcactgtccatcacactccctccctcccctcg

SEQ ID NO: 1030 - DNA, 188 bp, Homo Sapiens
  Ovary
  sig_peptide 129..176: Von Heijne matrix; score 5.30; seq SSLMVQLISQVYS/CM
acaggaagtttgcctagaaggaataaattaactcttgttacttggtgagatcatggaagggaatgtaatttgttttaggtggtggtaattgtgagtttgaggctggcccaggaaatgagttgtcagatatgctgtcatcctcattaatggttcagcttatttctcaggtttatagttgtatgaggagg

SEQ ID NO: 1031 - DNA, 146 bp, Homo Sapiens
  Testis
  sig_peptide 57..98: Von Heijne matrix; score 5.30; seq FSYILCMLFCLFS/QD
actaatcccctatttaggttgtttacttttaggtattctgcatagagctgtgatggatgttctcatatatactttgcatgcttttctgcttattttctcaggataaatttctggaagtgacattgttgtgtgaaaggtacatgctt

SEQ ID NO: 1032 - DNA, 145 bp, Homo Sapiens
  Uterus
  sig_peptide 11..67: Von Heijne matrix
  score 5.20
  unsure 10: seq VTLAFSLLVLSES/AV; position 10 of amino acid sequence; Xaa =  * ,Trp
aycwtcttaaatgttatttttatattatgttacacttgcattctctttattggtgttatcagagtcagcagtactgaaaagaagagaaatcttttgracagggttaggttgtgtgacagggttaggttgtgtgacagggttacgg

SEQ ID NO: 1033 - DNA, 235 bp, Homo Sapiens
  Spleen
  sig_peptide 143..184: Von Heijne matrix; score 5.20; seq LLSGLWLSSVKEC/DD
aaggagtagtggctttgttcccagctcagtgaagggtggcatggtctctcctgtccacttcactctggattctttaaccctgtgaattactagacatggattccatctccaatgtggatgcctctcttcaccacaagaatacatgctcctttctgggctgtggcttagctcggtcaaggagtgtgatgactggcgagcagatggctgccttccatccatcgtccaccccctaagg

SEQ ID NO: 1034 - DNA, 181 bp, Homo Sapiens
  Testis
  sig_peptide 59..112: Von Heijne matrix; score 5.20; seq VFCFSWLMSSSSP/SI
atacaaaggaaattagtatgttccttgaggttcagggaatctatgtatatttcagatcatggttgcattttcagtcttctgtttttcatggttgatgagttcatcaagtccttccatcttttggagtcatttctattcaccattcaaggatctatctaaaatgtataattatgtctccccg

SEQ ID NO: 1035 - DNA, 248 bp, Homo Sapiens
  Spleen
  sig_peptide 123..170: Von Heijne matrix; score 5.10; seq LALGIGPPGCLQG/SP
atgttttcttaagatccagaagtttttgctttagcttaaggatgtgtgcaattttccatgtggcttcataattcatccatgactttgaattttaaaatggagagaagttggcttcccaggaaatggtgcccctggccctgggcatcggcccacctggctgtctccaaggctctccttcccagtggctggtgcgggctccgggagctcagctgagtcccattggggtggcaacggaaagggagcagagg

SEQ ID NO: 1036 - DNA, 186 bp, Homo Sapiens
  Uterus
  sig_peptide 64..159: Von Heijne matrix; score 5.10; seq LLWFCTAMRPGGA/GL
aggattaagcaagcacagccctagttgatcacccagcatgaaaagtcctggaatctctcagagatgaacctgtgtatgggagttttgcttaaagtkggtacttcaagaaggtgcctctgtttactttggttttgcactgccatgcgaccaggtggtgcaggtctcccaaatgccacccccgaatgg

SEQ ID NO: 1037 - DNA, 159 bp, Homo Sapiens
  Uterus
  sig_peptide 112..153: Von Heijne matrix; score 5.10; seq SLAKSLFLRVARG/LG
atttttaagggaaagacccggaaacagcacattctctttttccagtagccggaatttgcaactacatatagtcgcaaagaagactgggaggwwatctttagttgggaagcaatgagtctagcaaaatctctgtttttaagggtggcaaggggactgggg

SEQ ID NO: 1038 - DNA, 342 bp, Homo Sapiens
  Ovary
  sig_peptide 61..114: Von Heijne matrix; score 5.10; seq FLPSATLLLSAES/FF
aagggctctgcctcttccctataccatgctgtcttccatagccttcctcctgtcctactcatgagactgcctccatttcttccttctgcaaccctgctcctatcagctgaatccttctttcggagtgttagtgagtacccgtctctccccagcccctcagctggtgggcctgggtgtgtcagcggcaaatggggctctggttccaatgggccactctcatctctctcttgttccttgtgcagaaaacctttgcttcactccactgccctctctagttcccgaccctttttctctcctggctttccctgccaaatttctccaaggagtggtctacaycctctg

SEQ ID NO: 1039 - DNA, 354 bp, Homo Sapiens
  Ovary
  sig_peptide 202..348: Von Heijne matrix; score 5.00; seq PLLLLLREELVTG/AV
atatttagttcctttatttttttcttttcaaatgaatggcttttaaagtacatgttatgtgaagtattcacaaacactggtgcttccatgattattgaggaacatgtgatttataaaatgcctcactgttttccaagatacacgattgcgtctgggcacagttgatttctccttgcctactccccctcgcccctcacccccatgagtgacagaaaaagaactaaattctcatatgtccaactcccatgcccaatctcccttctcccacgcagttttaaaaggggacaaatcccaggtccctcggctccaccacttcttcttcttctgcgtgaggagttggttaccggggccgtg

SEQ ID NO: 1040 - DNA, 248 bp, Homo Sapiens
  Ovary
  sig_peptide 12..134: Von Heijne matrix
  score 5.00
  unsure -4: seq FCFFPAFLVXVXS/QP
  position -4 of amino acid sequence
  unsure -2: Xaa = Ser,Thr; position -2 of amino acid sequence; Xaa = Phe,Leu
actcttcgtttatgactccgttgggctccggccctcctagagaggcctccatagcgcaggttcgtgggttctcgcggacctttttccgtgtagctttctgcttcttcccggcattccttgttwcggttttmtcacagccctctggmttttccaccactgagacactttgcgctcaggacttcagtgacgtcatctttctgcggcgcgcrgacacccgccggtggaagaagaaacagctccgccgccgg

SEQ ID NO: 1041 - DNA, 242 bp, Homo Sapiens
  Testis
  sig_peptide 93..137: Von Heijne matrix
  score 5.00
  unsure 4: seq CSALFPLLSLLSC/KE
  position 4 of amino acid sequence
  unsure 16: Xaa = Ile,Met; position 16 of amino acid sequence; Xaa = Gly,Arg,Trp
atgtgctgaaacttaatcagcaatgtgatggtaataggtggggcctttaaaggtgattaagtcatgtgagtgacctttataaaaaaggcttcatgcgttgttcagctctctttccccttctatctcttttgtcatgcaaagagaggatrtggtgtttgtccacattggaggatgcagcgacadggcgtcaccttggaagtagagagcagccctcaggggatgctgagcctgtggaagtatgg

SEQ ID NO: 1042 - DNA, 145 bp, Homo Sapiens
  Ovary
  sig_peptide 41..103: Von Heijne matrix; score 5.00; seq IISLLKLCSFCFI/KD
aatttaagataatatccagttcatgtagacatgaatatatatgctttatgatcaatattacctgataatatcactactaaagctatgttctttttgctttattaaagattttaaagccagcaacatcactttggtagtgatattg

SEQ ID NO: 1043 - DNA, 295 bp, Homo Sapiens
  Uterus
  sig_peptide 71..265: Von Heijne matrix; score 5.00; seq LCSFLSLRFCTLS/FM
aggagaccgtgcccacccctagattgttcttaagctcttttttgcatcttttacttgcctagactctgaaatggctaactgtttcctatcacataagagccaaactattctaatttcaaagcctgctctgactcagtcccattttacctctccagccggcttgtttctaactgttgagaaatcacaccttttgacaaggctgttttttcactggctttcgttagtgctgtgctcgtttctgtctttgagattttgcacattatcttttatgtgctcttttgcccttttccacctg

SEQ ID NO: 1044 - DNA, 298 bp, Homo Sapiens
  Testis
  sig_peptide 20..73: Von Heijne matrix; score 5.00; seq LTYLLFLPDWAAV/FE
aacggacagatttattggaatgcatggagctggtctgacctatttacttttccttccagactgggctgctgtatttgaactgtacaactgtgaagatgaacgctgttacttagacttggccaggctgagaggcgttcactacatcacttggcgacggcagaacaaagtctttcctcaggataagggccaccatccaaccctgggggagcacccgaagttcaccaactactctttcgatgtagaagaatttatgtatcttgtccttcaggctgcagaccacgtattgcaacaccccggg

SEQ ID NO: 1045 - DNA, 148 bp, Homo Sapiens
  Ovary
  sig_peptide 26..70: Von Heijne matrix; score 4.90; seq CLSATLAFSGSFL/AP
acgccaaactcctccagctggccccatgtgctgcctttctgccacgctagccttttcaggctcttttctggctccccacctcatcttttgctgtttctcccacctgaatgtcatcatcctcctatcctcattatcccctatccacggg

SEQ ID NO: 1046 - DNA, 172 bp, Homo Sapiens
  Ovary
  sig_peptide 38..154: Von Heijne matrix; score 4.90; seq SGLRGLLLQEALG/AV
aacagaagaaagacagcctaggagcagagcctcccagatggctgagttggatctaatggctccagggccactgcccagggccactgctcagcccccagcccctctcagcccagactctgggttgagggggctgctgttgcaggaggccctgggagcagtgccggaccccagg

SEQ ID NO: 1047 - DNA, 370 bp, Homo Sapiens
  Ovary
  sig_peptide 203..286: Von Heijne matrix
  score 4.90
  unsure -1: seq FLVACPLFGVCLX/FF; position -1 of amino acid sequence; Xaa = Ile,Lys,Met
acttcagtaaatctattattgatgtaatacttttgtctaattascattcatattctaattttgtcagttgttcaataatatcctttttgacaatttttcctccagtgagggatcaagtctagggctggatattgtgtttcattgtcatgtatcttgagtcccctttaatctgggagagttcctcagctttgctttgtgtcttatgacattaacacatgggaataatatcctccacctcgccaacttttttttagtagcatgtcctttatttggggtttgcctgawrtttttcattcttagattcaggttatacattcaaggcccaaatgtcacacaagtgatattgcatctgtctcagggaaccttgagc

SEQ ID NO: 1048 - DNA, 228 bp, Homo Sapiens
  Ovary
  sig_peptide 181..222: Von Heijne matrix; score 4.90; seq VLRWLPWPRGSHS/DS
aagtatccagcctcaacattcagcagaggccccagatcagcgtctgagccaggccaacaatgaccaaggaggatgggatcctgggtgcagctcatcacaagcgtcgggtgagtccgaggccccagctctctgccctcctgmtcctctgctctctcctggtcctcccagttctactggctcatggtgttgagatggttgccttggcctagggggtcacacagcgactcg

SEQ ID NO: 1049 - DNA, 166 bp, Homo Sapiens
  Uterus
  sig_peptide 50..121: Von Heijne matrix; score 4.80; seq FSFLGTLFHKSNS/ED
atagtattgatgctgggtcaaactagttaggaggattttcagttctcccatgaaagcaaggctctctggtaatctgatttgtttttcttttctaggaaccctctttcataaatcaaactcagaagacagctctgtaggaaaaggagactggaagaagaaaaataag

SEQ ID NO: 1050 - DNA, 217 bp, Homo Sapiens
  Ovary
  sig_peptide 107..154: Von Heijne matrix; score 4.80; seq VCLVPQTPSLCLG/KG
aatgaacgaacggggaaagtgcatgttgtagttctcaaaacccaaaaaaatctaagagaaacccagcagcaagaaacacagaggtttgggtgtcagcatcggaggaatgtctcacgtctgccttgtcccccagaccccgtccctgtgtctgggcaaaggcacgccccgctccaggtcggccccatttcagagcagtggccctcataggctttgtgcg

SEQ ID NO: 1051 - DNA, 296 bp, Homo Sapiens
  Spleen
  sig_peptide 93..179: Von Heijne matrix; score 4.80; seq VLTSVNLFIGING/SV
actgcttccagcakaagtcctatgtgtcctccaccaatctgcctgtgctagcccttctacttttgctgtatgggtggtcaatcacacctctcatgtacccagcctcctttgtgttcaagatccccagcacagcctatgtggtgctcaccagcgtgaacctcttcattggcattaatggcagcgtggccacctttgtgctggagctgttcaccgacaataagctgaataatatcaatgatatcctgaagtccgtgttcttgatcttcccacatttttgcctgggacgagggcagacg

SEQ ID NO: 1052 - DNA, 290 bp, Homo Sapiens
  Testis
  sig_peptide 165..254: Von Heijne matrix
  score 4.80
  unsure -19: seq RSSLWVTAPLVSA/CP; position -19 of amino acid sequence; Xaa = Arg,Thr
aagagcctcttgsatccccacagggyaatgggtgtbccgatctcgcgggggactctgtgatccgtgttcccctgaccctcctagtgcacaacttggccgggctcactgggctcctgcaccactgcctgtcaggtccgctgccagccccaagccccccaccagccatgagctcctccagaaaggaccacctcggcgccasagctcagagcccctcccggtcatcattgtgggtaacggcccctctggtatctgcctgtcctacctgctctccggctacacaccctacgggg

SEQ ID NO: 1053 - DNA, 397 bp, Homo Sapiens
  Spleen
  sig_peptide 230..286: Von Heijne matrix
  score 4.80
  unsure 8: seq ATYLVQSSACCPA/IV
  position 8 of amino acid sequence
  unsure 20: Xaa = Leu,Ser,Trp; position 20 of amino acid sequence; Xaa = Asp,Glu
accacggggacaaggactgckcccacgatggtgctcctgccavgccccagctgbacggggagtcctgtggggcccaggccttgaacagccacatgcctgctgagaccgaggagctgggacggtggggaccacagagagcaacctgattacctccctgcttgggctgtgccagagcaagaagagtcgggtggccttgaaggcccaggagaacctgctgctcctggtgagcatggcctccccagcagctgccacctacctggtacagagcagcgcctgctgccctgcgatcgtccggcacctttgccagtbgtaccggtccatgcctgtcttcctggaccccgcagasattgccaccttagagggcatcagctggaggttacccagtgccccgtctgat

SEQ ID NO: 1054 - DNA, 378 bp, Homo Sapiens
  Testis
  sig_peptide 172..354: Von Heijne matrix
  score 4.70
  seq LLPCNLHXSWLHS/SP
  misc_feature 304: n=a, g, c or t
  unsure -17: position -17 of amino acid sequence
  unsure -6: Xaa =  * ,Ala,Glu,Lys,Pro,Gln,Ser,Thr; position -6 of amino acid sequence; Xaa =  * ,Cys
agattggctgggcagatgggctgactggctgggcagatgggtgggtgagttccctctccccagagccatcggccaggtaccaaagctcagctgtatggattcccaacaggaggacctgcgcttccctgggacccattgttgtactggattaacaagcgacggcgctacggcatgaatgcagccatcaacacgggccctgcccctgctgtcaccaagactgagactgaggtccagaatccagatgttctgtgggatttggacatccccgaagccaggagccatgctgaccaagacagcaacccbnmggcggaagccctgctcccctgcaacctgcactgmagctggctccacagcagccccaggccagatccccattcc

SEQ ID NO: 1055 - DNA, 362 bp, Homo Sapiens
  Testis
  sig_peptide 180..308: Von Heijne matrix
  score 4.70
  seq GIFLVIFCSESFS/LL
  misc_feature 120..121: n=a, g, c or t
  unsure -20: position -20 of amino acid sequence; Xaa = Cys,Phe,Leu,Trp
aatggamttctgggttgacaratgttttgttgtgttttgtttatwcctcatctgttctctattgtttctagtttgtagtcagcattcataggtgtacttgattcctcctatrwtattagnntctagctgttttcaggratttctctttkatttttgagttccagtagtttgactataatatgataaacctacttgtgggtaactgcatttatctgcttggagctattagagcttcttgcatgtgtagatkbatgtctttcgccaaatttgggatttttcttgtaatattttgttctgaatcattttctcttctcctctggaacttcagttcaatatatgttaagaccttttggccagtgggg

SEQ ID NO: 1056 - DNA, 171 bp, Homo Sapiens
  Spleen
  sig_peptide 16..72: Von Heijne matrix; score 4.70; seq LRFLLRDPGCLLA/QP
aagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccccg

SEQ ID NO: 1057 - DNA, 437 bp, Homo Sapiens
  Spleen
  sig_peptide 360..416: Von Heijne matrix; score 4.70; seq ILLRMTVLPTLWT/RR
aagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccagatcgagcctgcgtgctgccgaagcagggcgccgagtccatgcgaactgccacctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtg

SEQ ID NO: 1058 - DNA, 153 bp, Homo Sapiens
  Ovary
  sig_peptide 31..99: Von Heijne matrix
  score 4.60
  unsure -5: seq VRVGLVLVXRALC/LX
  position -5 of amino acid sequence
  unsure 2: Xaa =  * ,Ser
  position 2 of amino acid sequence
  unsure 10: Xaa = Cys,Phe; position 10 of amino acid sequence; Xaa = Arg,Thr
agggaagggagggcaggcggkgctggagtbatgtggtggaaacctgctcctgaggaaggggtccgggtggggttggtgcttgtgtsaagggctctgtgcctctktgtactctctcggttcatgttcasaaatcctggccttggtggcatgggg

SEQ ID NO: 1059 - DNA, 454 bp, Homo Sapiens
  Testis
  sig_peptide 374..415: Von Heijne matrix
  score 4.60
  seq FNFLLGNSSCVYQ/RP
  misc_feature 286..287: n=a, g, c or t
aattctggcccagcttcttccccagctctatcctgcttccctccatctcctataggattctccttagagttctccctccattagtagttgtcttagggtctgtttctggggagccctgcctaagactcatgctacaagaagttaaataagtttcccgaagtcacacagctagcctctcatcccttttctactgagaggaagtggaatgcactccgacaaggataaggttttattgtgagctggccttggaattaaaccaccaccaacacacttttggattatcagnnggtggaaggagtgcaaatgccagttacggtgatgcgttcaacatccttatttccagttcagaatttccctggagctccaaatttttatgtttaatttcttactgggcaattccagttgtgtatatcaaaggcccatcagattaaaactcattatcttcccatcaggg

SEQ ID NO: 1060 - DNA, 413 bp, Homo Sapiens
  Testis
  sig_peptide 57..182: Von Heijne matrix
  score 4.60
  unsure 50: seq LDPAVSLSAPAFA/SA
  position 50 of amino acid sequence
  unsure 52: Xaa = Lys,Asn,Thr
  position 52 of amino acid sequence
  unsure 54: Xaa = Arg,Ser
  position 54 of amino acid sequence
  unsure 55,61: Xaa = His,Leu
  position 55, 61 of amino acid sequence
  unsure 56,65: Xaa =  * ,Cys
  position 56, 65 of amino acid sequence
  unsure 67: Xaa = Ile,Leu
  position 67 of amino acid sequence
  unsure 68: Xaa = Leu,Met; position 68 of amino acid sequence; Xaa = Pro,Thr
draaaccggagccacagaggacagggtagagtcgcagaaaggagagacacacatacatgaaaagaggagctttctccaatcttaatgattcccagctctcagcctcgtttctgcaacccagcctgcaagcaaactgtcctgctttggaccctgctgtgtcactctccgcaccagcctttgcctctgctcttcgctctatgaagtcctcccaggctgcacggaaggacgactttctcaggtctcttagtgatggagactcagggacatcagaacacatctcagcggtggtgactagccctcggatttcctgccatggtgctgccattcccammgcmmgtgcccwctgmmtaggctgttcctgctgmaccgaacgmmtcctcmtgmcaccgccctccctcctttctttagaagcc

SEQ ID NO: 1061 - DNA, 271 bp, Homo Sapiens
  Testis
  sig_peptide 32..103: Von Heijne matrix; score 4.60; seq FFIFCSLNTLLLG/GV
aacaactatcctgcctgctgcttgctgcaccatgaagtctgccaagctgggatttcttctaagattcttcatcttctgctcattgaataccctgttattgggtggtgttaataaaattgcggagaagatatgtggagacctcaaagatccctgcaaattggacatgaattttggaagctgctatgaagttcactttagatatttctacaacagaacctccaaaagatgtgaaacttttgtcttctccagctgtaatggcaaccttaacggg

SEQ ID NO: 1062 - DNA, 150 bp, Homo Sapiens
  Testis
  sig_peptide 31..75: Von Heijne matrix
  score 4.60
  unsure 7: seq ILFPLHSVIGSHP/QC; position 7 of amino acid sequence; Xaa = Arg,Trp
aagttgcctgaggacagcagtscagttgacatggatattctctttcctctgcacagtgttattgggagccatcctcagtgcctcccagagaggwggacagcgagaatgatcaagctgaagtgggggaatggctcaggatcggatttcggg

SEQ ID NO: 1063 - DNA, 430 bp, Homo Sapiens
  Testis
  sig_peptide 275..355: Von Heijne matrix
  score 4.60
  seq FGILILLSQRQWS/KN
  misc_feature 139: n=a, g, c or t
  unsure -20: position -20 of amino acid sequence; Xaa =  * ,Cys
gttggaaaacagttttggctctgaggacccagcagttgacaaacaggaggcctgggacaagagcagtatgagaagtcagatcgcctcttttaatgtcactagtcagtacaggcctcgccagacaagtctctcctcarmntcacttggaagaacaggccsdctcttcatgatcctgggtttcctagacwtatttccaggactgttatggggattagggccaactgtaaaagtggctgaggagactaggtaaagagtgttgtctcactttagaacaatgctgaaggtgtttagagcctgmcatcctaaaatatgccactttggcatactgattcttctgagccagaggcaatggagcaaaaacagatgcagggaaggctgtctgaccaccctctttctgtttgaagcggaacataaaagttcccttgtgaaa

SEQ ID NO: 1064 - DNA, 353 bp, Homo Sapiens
  Uterus
  sig_peptide 219..320: Von Heijne matrix
  score 4.60
  unsure -12: seq LXWRKLAASWTLS/QE; position -12 of amino acid sequence; Xaa = Ile,Val
acaattaaaccacacagaaaatgatgtgactcatcttcaaaaggaaatgagcaattgtagagcaggtgaaaacgctggcatgggtaggttcactaaggtgggtgagcaagaaaggacagtggacaccctgccgtccccccagcaccccgtggctcattgctgcagtcagctggaggagaggtggcagaggttgcagagccaggtcatctcggagctggatgcttgtaaggaatgcacgcagggggtccagagggaggtctccatggtggagggcagggtgtctmrtatggagaaaacttgcagcaagctggactctatctcaggaaatcttcagaggatcaaggaagggctcg

SEQ ID NO: 1065 - DNA, 216 bp, Homo Sapiens
  Ovary
  sig_peptide 61..147: Von Heijne matrix; score 4.50; seq FTLGLGYPIPTRL/QP
gatggcggcgasgsggacggtsaaggttgcctcccgcccgtccgggctctgatcctccccatgactaaagggcatcaccaccagcatcccctgcatccccacccactcttcaccctgggcttgggataccccatacccactcgcctgcaaccatgcacattaagctcagacccccttctggacattacctgttccctgagaagcccaagctctggg

SEQ ID NO: 1066 - DNA, 236 bp, Homo Sapiens
  Spleen
  sig_peptide 162..230: Von Heijne matrix
  score 4.50
  unsure -19: seq RLHILFIVCLARG/KG; position -19 of amino acid sequence; Xaa = Cys,Asp,Gly,Tyr
agctgcttagtttgctaattctagtggttcaaaccagatttcaaaatctgggctaaatctctgtcatgctatgacatggcatttgacagtaattcctgaatatttaattgatagaaaaacagaaagcatgcatattgtttagtacaattgtgtgaactgctatgacatatcatkrcatacagttttctgaaagactgcatattttattcattgtatgcctagcacggggaaaaggg

SEQ ID NO: 1067 - DNA, 230 bp, Homo Sapiens
  Ovary
  sig_peptide 9..146: Von Heijne matrix; score 4.50; seq LIYCGLSQPLTLG/VT
attgtatcatgtctcaatttcctctctgcagccctccgtggaaaccacttgtcaaggtctccagaaacctgaaaataaggatgtccattccatggccactctcagtcctgatttactgtggtctctcgcagcctttgaccctgggggtcacctctccttccttcccccaaaactctttcttcccttggcttccagaacaccccactcacctggtctcctctaccccacag

SEQ ID NO: 1068 - DNA, 445 bp, Homo Sapiens
  Testis
  sig_peptide 26..100: Von Heijne matrix
  score 4.40
  seq AMGFLLMFDLTSQ/QS
  misc_feature 335: n=a, g, c or t
  unsure 79: position 79 of amino acid sequence; Xaa =  * ,Glu,Gly,Lys,Gln,Arg,Trp
aaaaggacatctggctgtgcaatccatgttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgnrgcgaatggaacagtgtgtggagaagacacaaatccctgatactgtcaatggtggaaattctggaaacttggatggggaaagccaccagagaagaaatgtatctgctaga

SEQ ID NO: 1069 - DNA, 319 bp, Homo Sapiens
  Testis
  sig_peptide 185..295: Von Heijne matrix
  score 4.40
  unsure -1: seq LSYASSALSPCLX/AP; position -1 of amino acid sequence; Xaa = Ile,Asn,Thr
atcaccttcttctccatccttstctgggccagtccccarcccagtccctctcctgacctgcccagcccaagtcagccttcagcacgcgcttttctgcacacagatattccaggcctacctggcattccaggacctccgmaatgatgctccagtcccttacaagcgcttcctggatgagggtggcatggtgctgaccaccctccccttgccctctgccaacagccctgtgaacatgcccaccactggccccaacagcctgagttatgctagctctgccctgtccccctgtctgahcgctccaaagtccccccgacttggg

SEQ ID NO: 1070 - DNA, 270 bp, Homo Sapiens
  Testis
  sig_peptide 106..195: Von Heijne matrix
  score 4.30
  seq LLPTLPWLPSTRL/LS
  misc_feature 49: n=a, g, c or t
  unsure 15: position 15 of amino acid sequence; Xaa = Ala,Ser,Thr
agcacagcgctgrratgccaggttcgggtaggaggccccttgggggrmnrattctttaggaaattcctttagaagvaaacaacttgggactggatagcgtgcgatatgcagagaaatgcaactttcattcatttgcagttagcgatccgcccttccctgctccccacccttccgtggctccccagtacccgcctgctgtcgcccacacccttaggacagcttcgtggccccccgggadcgcagagggccatgcctaccgctcatttaaga

SEQ ID NO: 1071 - DNA, 109 bp, Homo Sapiens
  Ovary
  sig_peptide 50..94: Von Heijne matrix; score 4.30; seq ILFCFHSFHPLFQ/DT
acatatatctatcctgacaatatttagcagttcaaaaggtaataagattatgaatatattattttgctttcattcttttcaccctctatttcaagacactatcgaattt

SEQ ID NO: 1072 - DNA, 371 bp, Homo Sapiens
  Spleen
  sig_peptide 198..257: Von Heijne matrix; score 4.30; seq FNFLFLVQLCILA/CD
aagataaattggggaattctagggaaacccttgaataccaagatagaaaactaaagtttttacttcatttggtcatgggaaacttgcactgagcatgggagtcaataattagaagcaagtkaaattcaaaaagtcgaaccccattcataaaaccagctgatagtctgaaaatacgctttgagctaagcaaagaatacatgttgacaaatcgtaactactttaacttcctttttcttgtacaattgtgcatcctggcttgtgacaatgcataccttcagtcgtgtcccctcacctcaaagactcctctgttacaaacccactctgctcttttctataatagtacatatgggattttcctactcctaggagtg

SEQ ID NO: 1073 - DNA, 363 bp, Homo Sapiens
  Testis
  sig_peptide 190..267: Von Heijne matrix; score 4.30; seq ALCRFVGMQPCTA/QT
aattctcaacagttgcattggaatgtaaggtcagggcaccactgagttcagtacttcaaaattgccgtgctctacctctccccagtgcacaaaaacactctccacaccaagctgctgctgctgggatggagggatggcgtcasgattcaagactgtttttcctacctgttcagcacttctttcagcgatatgaagttaaatccaggccaagttcccacctggtgggaagcactgtgcaggttcgtggggatgcagccctgcacagcccagactggactccttccccatggaactcacaacacacgggagaggcagagagatccaagcgcacagaaaaacacaagaagattcagccctgttggg

SEQ ID NO: 1074 - DNA, 186 bp, Homo Sapiens
  Spleen
  sig_peptide 97..177: Von Heijne matrix; score 4.30; seq LCLNLCPCSSSLL/SP
actcttgtagtggmgccggcttgcatcccaggtcgtggcggttttggtgcctgaagcagggagcgcggagtcgttcccgagagaggcggccaggctatgctcgccggtttccggcgttccgctccggccagccagagtctctgtctcaacctgtgtccgtgctccagcagtctcctcagcccggcg

SEQ ID NO: 1075 - DNA, 311 bp, Homo Sapiens
  Testis
  sig_peptide 237..290: Von Heijne matrix; score 4.30; seq SFYLLFFLNDVPP/CP
acagracaggttaaagagataatcatttgggactcaaatgtctctccccccgggcacttgcatatgggacattgagtccttttgttttcccttgatctatagctcttacccctctgcccagtaattccctgaggaagaggtaaagatcaragttgrtactttgtcctttccttccktcttcccttatttttaaagctgtcrsccacactgattcctgctctaatagcagagcagagatgaaggaaggagcttccttctatctgcttttctttctcaatgatgtcccaccatgtccccctcacacccccggg

SEQ ID NO: 1076 - DNA, 400 bp, Homo Sapiens
  Spleen
  sig_peptide 305..391: Von Heijne matrix; score 4.30; seq ETLLLKLSSQSRT/NR
atatttcagcttccacattttatttcaacaacattagtcatcgtagctgcgtattcctgtthtcagtgtagtaacgttgagcahttatgttcctagcactcttccaggtaccctgtgcgttatgaggcaggcacatctctcctgaaagaatttatattcttgtcagggaaataaggcttcagataagaaaaaattcgggggaaagtgcctaattccttctaccctaacctgcctccatttcctccctcctccgagttgagatgattgggtcagagccagctcttcctgggcttgggaagaggagatggggcttgagtgctgctgcccccctcataacctcagagtctatattgagactctcttgctcaaactctcctcgcagagtagaacgaacaggctg

SEQ ID NO: 1077 - DNA, 376 bp, Homo Sapiens
  Testis
  sig_peptide 275..337: Von Heijne matrix
  score 4.20
  seq VLSIAASLLQCRL/AV
  misc_feature 372: n=a, g, c or t
  unsure 12: position 12 of amino acid sequence; Xaa = Ala,Asp,Gly,His,Ile,Leu,Asn,Pro,Arg,Ser,Thr,Val
aatctgaaacagttctagtctcaagcattttggatgagggatacccatcctctattttatcaccattttcatgctgtattaaaatgaaattgccaactcagttcaaaggaatttttcttcttagctttacattgttgattcatggtggaggcgaacaaactatcgactggtgggttggataccttggtccagagaggtccttgtgacatatctcatggcccattacctaggtgatgtgagtcttgccttctgcctgcaataaagttttgttggaatgcagctatgcccatttactagtgtattgtccatagctgcttctctgctacaatgtagattagcagttgtaacagagactatatggcccccccagvnttgg

SEQ ID NO: 1078 - DNA, 354 bp, Homo Sapiens
  Testis
  sig_peptide 139..270: Von Heijne matrix
  score 4.20
  unsure 20: seq QLLFKLNSTWCRA/LQ; position 20 of amino acid sequence; Xaa = Met,Thr
accccyagaagttataaggaaasgccttccaacttgatacagttgcttttctttcctgaatcccctgtttactggaaatttcattggattttgggaggagagaggtctgaaggaaggaaaggcctgttttctgctgtaatggatgtaacatgctgctttgatgcagttgaaggaagtgacttcagggtttgctgtcatggatgcgtgtcttggctgtgtctccagatgctgcagcttttattcaagcttaatagcacttggtgcagagcactccagagtgaaacctcattggcttcccggcgcctgtggatgtgggtctctcatctgayggagttctttactgtgaccccctgg

SEQ ID NO: 1079 - DNA, 84 bp, Homo Sapiens
  Ovary
  sig_peptide 7..72: Von Heijne matrix; score 4.20; seq HCFCFTLFSYSSS/FF
aaggacatgagacaaggacctggggccccactccattgcttctgtttcacccttttttcctactcctcctcctttttttttttt

SEQ ID NO: 1080 - DNA, 140 bp, Homo Sapiens
  Testis
  sig_peptide 72..116: Von Heijne matrix
  score 4.20
  unsure -4: seq ITLLGIWLTXRLQ/FP; position -4 of amino acid sequence; Xaa = Cys,Gly
acaagcccccggcttgctcatttcatccaggtgaggagtctggagtagagcagggcttctgaaatggtgacatgcacatcactctcctgggcatctggttaacakgcaggctccagttccccaggtctgggcgggctggg

SEQ ID NO: 1081 - DNA, 316 bp, Homo Sapiens
  Spleen
  sig_peptide 245..295: Von Heijne matrix; score 4.20; seq SWVCLLSAGTAFE/DY
atttaggattttagactttagggattttgatctttggggatttcaatatttgggattatggtatttgagatggtctcttttaggattatgatccaaacccatctcaggaatgtgtgaaatttacagtagtccatccccatcccgggctgtagaaatgtaggacccacaagccttcgttacagagccacttactgccccatggagttcccaggtagatgacagtagcggggaggatacatggcacatgttatatggctcttgggtgtgccttctctcagcaggcactgcctttgaagattatcatttggggggtacg

SEQ ID NO: 1082 - DNA, 208 bp, Homo Sapiens
  Uterus
  sig_peptide 59..154: Von Heijne matrix
  score 4.20
  seq XXXXFLLGRRVVG/ES
  misc_feature 162: n=a, g, c or t
  unsure -13: position -13 of amino acid sequence
  unsure -12: Xaa = Gly,Val
  position -12 of amino acid sequence
  unsure -11: Xaa = Leu,Val
  position -11 of amino acid sequence
  unsure -10: Xaa = Leu,Met
  position -10 of amino acid sequence
  unsure 3: Xaa = Ala,Leu,Pro,Val; position 3 of amino acid sequence; Xaa = His,Leu,Pro,Arg
actatttttcccttcattgtctttactttgcttcagaagaatagtctgtgatgacgccatgttattttttccccttctttctttccgatttctaccctcagagagtttgttgaaagkcbtawtgsyttttttgctggggaggagggtagtaggagaatcacnttttattttcacatgtggaaatttgcttttaatttggccttacggg

SEQ ID NO: 1083 - DNA, 187 bp, Homo Sapiens
  Testis
  sig_peptide 113..160: Von Heijne matrix; score 4.20; seq WAILGCWGTLSRG/HL
atgaaaattttccatgctgtytgaggaaacatattttgtgggagcagatcattatcatgagagttgaaacaaaaaaactacatggaggtggaacctgccagcccagtggtggatgccagtctgggccatactgggctgctggggcacactcagcaggggacatctgcctgtgtccttggacccaaag

SEQ ID NO: 1084 - DNA, 253 bp, Homo Sapiens
  Ovary
  sig_peptide 134..247: Von Heijne matrix; score 4.10; seq GILCGSLPGPSLC/PP
acaagttcacctggcctcctcttctccagcctcagtcaccttctgctgaacagctccaccttggccttgcttactcacagactaagccagatgacctgcctgcagagcctcaggtgagtgaccgagcggccccatgggaatgagtgggaagaaacacttcccactcagttgggaccacatccagggaagcactgaggccacctcccaggggatcctttgcggatccctcccaggcccatccctgtgccctccg

SEQ ID NO: 1085 - DNA, 362 bp, Homo Sapiens
  Testis
  sig_peptide 141..251: Von Heijne matrix
  score 4.00
  unsure 26: seq PLSLDCGHSLCRA/CI
  position 26 of amino acid sequence
  unsure 28: Xaa = Asp,Tyr; position 28 of amino acid sequence; Xaa = Phe,Val
aacacccaccctggcttttcttcacctcttcaaccaggagccgagatttctgttgctctgaagccatccaggggtctttaaccagaagagagaggagagcctcaggagttaggaccagaagaagccagggaakcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagtkactcakttgaacatctacaggctaatcagcatcgg

SEQ ID NO: 1086 - DNA, 140 bp, Homo Sapiens
  Testis
  sig_peptide 48..89: Von Heijne matrix; score 4.00; seq YYMVCLFFRLIFS/EH
aggagatagcctcgtagaaatgacaaccacaatgttaatactaacatatgtattacatggtttgtttgttctttcgcttaatattttcagagcacctacctattataggcactgtcacttctcacaaaactgggacaggg

SEQ ID NO: 1087 - DNA, 158 bp, Homo Sapiens
  Ovary
  sig_peptide 15..122: Von Heijne matrix
  score 4.00
  unsure -31: seq KLAGLWSPGLVPA/AP; position -31 of amino acid sequence; Xaa = Gly,Arg
aagtgtcgcgataaatgggcgccggcggasggagggagatccgagcggcggcggcaagctggctgcgagcggctgagcactccaagctcgccggcctttggtctccaggacttgtcccagcagcccctcgaactgagaattacaccatcggacccctg

SEQ ID NO: 1088 - DNA, 291 bp, Homo Sapiens
  Testis
  sig_peptide 52..231: Von Heijne matrix; score 4.00; seq LVRRTLLVAALRA/WM
aaggaaacagcaaccagagggagatgatcacctgaaccactgctccaaaccatgggcagtaaatgctgtaaaggtggtccagatgaagatgcagtagaaagacagaggcggcagaagttgcttcttgcacaactgcatcacagaaaaagggtgaargcagctgggcagatccaggcctggtggcgtggggtcctggtgcgcaggaccctgctggttgctgccctcagggcctggatgattcagtgctggtggaggacgttggtgcagagacggatccgtcagcggcggcag

SEQ ID NO: 1089 - DNA, 192 bp, Homo Sapiens
  Ovary
  sig_peptide 103..180: Von Heijne matrix; score 4.00; seq SIHSWQLLTSAQP/QQ
cggcaacgcgcggcggctcaacggcctggcagaggtttcagcgctgagcaggcctgagttccgtcatggccctctattatgaccaccagatagaagccccggatgcagcagggtcaccctcatttatcagctggcaccctgtccatccattcttggcagttgcttacatcagcacaacctcaacaggcaggg

SEQ ID NO: 1090 - DNA, 174 bp, Homo Sapiens
  Ovary
  sig_peptide 1..147: Von Heijne matrix
  score 4.00
  unsure -44: seq ATCCLSLFQWCAV/LR
  position -44 of amino acid sequence
  unsure -26: Xaa =  * ,Ser
  position -26 of amino acid sequence
  unsure -25: Xaa = Arg,Thr; position -25 of amino acid sequence; Xaa = Asp,Asn
atgtctagatatgagtmaggatcctccttattgccatttccagaccatttctctgtttactcctttaaaasaratagtttttttgaagcgtacagcatttcagattatgccacctgctgtctctccttatttcagtggtgtgcagttctgagattcctgtctctgccccttccg

SEQ ID NO: 1091 - DNA, 226 bp, Homo Sapiens
  Ovary
  sig_peptide 140..211: Von Heijne matrix; score 3.90; seq LLLHHYLLLFITT/SR
acagttgtggctctcaactctcctttttgtgtactgctatacttgagtagcacacagccataccaatttccagggtgctcagattcattctaccctttcctactggaagaggtaaaaaagcaacaccctagaatctgatatgatttattttatcaaaataaacaataagctactgcttttgcaccattacttgcttctatttataacaacctctcgccccacaggg

SEQ ID NO: 1092 - DNA, 129 bp, Homo Sapiens
  Ovary
  sig_peptide 28..108: Von Heijne matrix
  score 3.90
  seq LSWALCLSQSGYY/HP
  misc_feature 13: n=a, g, c or t
agggtatatttcntgtcccctaggagcatggagcttttgtaccttaaagttaagagaggacaaaaggatctgagctgggctttgtgcctttcccagagtggttattaccacccttcccacccccattgg

SEQ ID NO: 1093 - DNA, 158 bp, Homo Sapiens
  Ovary
  sig_peptide 36..77: Von Heijne matrix
  score 3.90
  unsure 19: seq TLAVTLSALGATG/LF; position 19 of amino acid sequence; Xaa = Phe,Leu
agaggccagattmtgcaggcctgtgggctgacacaatgactttggctgttactctgagtgcattgggggccaccggattgtttaaggaggcttgtgatctaacctttttaaacataggtcagatcacaagcytccttaaacaatccggtggcccccag

SEQ ID NO: 1094 - DNA, 330 bp, Homo Sapiens
  Uterus
  sig_peptide 115..237: Von Heijne matrix
  score 3.90
  unsure 7: seq CRCLITLPRSCRP/ST
  position 7 of amino acid sequence
  unsure 17: Xaa = Ala,Thr; position 17 of amino acid sequence; Xaa = Ala,Gly,Pro,Arg
atttgacgtgtctgtttcatgtytcctttgagtaaaacctaatctttctcaatagagaagtttattcttgaagtatgtgkkctcagttcattcscctgagtgacacaagctcccatgcttgggccacccttgcagcccggaagccatgggaaggtcctcgcccctcagggcagtagtggcctgacaccccccttcccgtgcaggtgtctgataactctgccgcggtcgtgccggcccagtacatctgtgccccggrcagcaagcacacgttcctcgcagcgcccgsscagctcctgctggmgaagttcctgcagcaccacagccaccatg

SEQ ID NO: 1095 - DNA, 207 bp, Homo Sapiens
  Testis
  sig_peptide 64..144: Von Heijne matrix
  score 3.80
  unsure -11: seq QLXLILVHFPAYS/VE; position -11 of amino acid sequence; Xaa = Ala,Ser,Thr
aaactgccatcygcaactgaactttggcagtaaacacagcttagttgtctcagaggattcacaatgggaaatgtttgtagttgctgcctcagagcaagatatcarcagttgdctttaattttagttcatttcccagcatattctgttgaagatcaaagagtggatcctggggtgccaggggaatccaccgtctgccaccacaatcgg

SEQ ID NO: 1096 - DNA, 130 bp, Homo Sapiens
  Spleen
  sig_peptide 8..70: Von Heijne matrix; score 3.80; seq PRCVISCIHGVWC/EE
actctgcatgctttatggccttggctctgggccaaggtgtgtgatctcctgcattcatggtgtgtggtgtgaggagggggatgggtccctgccccgtctgcacgtggccctcatgattcccgcgctaggg

SEQ ID NO: 1097 - DNA, 298 bp, Homo Sapiens
  Testis
  sig_peptide 62..187: Von Heijne matrix; score 3.80; seq VTPLDSCPPSAHS/AP
acagcttccactcttgtctccctaaaccctgttttcctcacagtaactagaattgtccttaatgcatagaatcatgactctccttcatctcaaagctctccaacagcttcagaataaaatccatgtccccaggatgctcccagggcctgtgacccctctggactcatgccctccttctgctcattctgctccatcactgctcacttcccagctacccctccaacacaccaatgcgcccccacctcacggcctctccctgcgccgtgccctccactggattgcccttcccttgatgggg

SEQ ID NO: 1098 - DNA, 149 bp, Homo Sapiens
  Ovary
  sig_peptide 93..131: Von Heijne matrix; score 3.80; seq MLFLVLFYSAIFL/FT
aaacaacaaaaaaaagtttaaaaattggaaaccaccaaaaggtagtattaaaagggaaataaaaattactcataatcccagaacgcagtcatatgctatttttagtcttattttattcagccatttttctctttacactaacttttttt

SEQ ID NO: 1099 - DNA, 180 bp, Homo Sapiens
  Ovary
  sig_peptide 133..174: Von Heijne matrix; score 3.80; seq VSLCVAALFPLQA/YG
aaagagtacctgaaaaccttagagaaccctggggaaatatttatagccaggcttcttggagactctgggaacaggaaagtcaggaaccctgcctttcaggaactgctgtatctcagtcgmmttcttcatttcatggtttctctctgtgtagctgctttatttcctcttcaggcttacggg

SEQ ID NO: 1100 - DNA, 283 bp, Homo Sapiens
  Testis
  sig_peptide 218..268: Von Heijne matrix; score 3.70; seq LFYIPSILTLLLA/CR
aaaattcttccasaatgctaatgtaaatctaatcagcctttagaatttaaaggcttaaaaaagactaaagaaaagtaacaaccaaatgcaatatgtagaacttatatggagcctgattcgaacatcaagtataaagagatatttttgagaaaattgagaaattttaaaacatgamatbagtattatatgatattgamgactgctgctttttcamgacatgtcctcaaatttattttacattccttccatactaactcttctccttgcatgtmgacagacaggg

SEQ ID NO: 1101 - DNA, 121 bp, Homo Sapiens
  Ovary
  sig_peptide 2..106: Von Heijne matrix; score 3.70; seq IKQFILCLGTCRG/EM
tatggggcttttgagaaagtgttttcccgtgatgctggggggaaacacacatattcaaattacttgtataaaacagtttattctgtgtttaggaacttgtaggggtgaaatgctgaccagg

SEQ ID NO: 1102 - DNA, 148 bp, Homo Sapiens
  Ovary
  sig_peptide 56..97: Von Heijne matrix
  score 3.70
  seq MLPLFCSPWESGG/RT
  misc_feature 121: n=a, g, c or t
  unsure 9: position 9 of amino acid sequence
  unsure 11: Xaa = Pro,Ser; position 11 of amino acid sequence; Xaa =  * ,Leu
taagccgagaaacttccgtactgtgttaaaaactgtttgaggaacactggattaaatgatgcttccactgttctgctctccctgggaaagcggaggcagaacggtgaagcagagtgaaggnycttgttwattccaggccccccatggg

SEQ ID NO: 1103 - DNA, 140 bp, Homo Sapiens
  Uterus
  sig_peptide 27..71: Von Heijne matrix; score 3.70; seq KLLSDLSVDSARC/KP
atcttaacagaactttacagactagcatggcaaagcttctctccgatcttagtgtggacagtgctcgctgcaagcctgggaataaccttaccaaatcactcttgaacattcatgataaacaacttcaacatgacccacgg

SEQ ID NO: 1104 - DNA, 417 bp, Homo Sapiens
  Testis
  sig_peptide 199..252: Von Heijne matrix
  score 3.70
  seq VCWGHLLPARVST/RS
  misc_feature 414: n=a, g, c or t
  unsure 54: position 54 of amino acid sequence; Xaa = His,Gln
agagaycaactctatttgagcaasagtkaggaagatttccctgtctcccagctgagtaaccactcaggtttatttaaatccagtttaaatatggtttcagtaatgattttccaatggtctacagcaaagaatggtgctccaagcctgaacattgagcacgacccaggtcatatgcacaacacgacaggttgagcgtccatgtgtggctactgggtttgctggggacacctcttgcctgccagggtgagcacacgcagcagtgagcagccccgtgtgaccccacgggatgaggatgccatgatgtcagcatcccttctgacttggaggtatgtgacattcatggtgccaatgccactgtcaccttgcagatcagtctgggtttgcttcagacagaagatcctggaatatgttcangca

SEQ ID NO: 1105 - DNA, 167 bp, Homo Sapiens
  Uterus
  sig_peptide 66..137: Von Heijne matrix; score 3.70; seq AILGLSTFLNLLS/IN
agctgcgcacagatsattgaattgcggggttgctgtaggaaccgctgctattgccgcaggaggagatgaagttatcttgtgcaggctgtgcagacacagccattttgggactcagcactttccttaatttactttccatcaacctgctcggaatgatttctttctct

SEQ ID NO: 1106 - DNA, 248 bp, Homo Sapiens
  Spleen
  sig_peptide 75..137: Von Heijne matrix
  score 3.70
  seq FSLGSCPAGPLSA/CV
  misc_feature 15: n=a, g, c or t
  unsure 20: position 20 of amino acid sequence
  unsure 23: Xaa =  * ,Gly; position 23 of amino acid sequence; Xaa = Lys,Asn,Arg,Ser
atgtcacatttaasnagaggccagagcttgtccaaaatggctgtccrwamacgaccccacacttgcgttagaagatgatacctttttcagggacagttttctctcttggctcctgtcccgctggccctctgtctgcctgtgtccctgaccatggctccctgcagtaccctttaacgatttatcagcaagactgtkgaacgcatarstgcccaagatgcctgtccctccccctccagcacccccgacag

SEQ ID NO: 1107 - DNA, 360 bp, Homo Sapiens
  Testis
  sig_peptide 70..174: Von Heijne matrix
  score 3.70
  unsure -26: seq PAVSLSAPAFASA/LR
  position -26 of amino acid sequence
  unsure -15: Xaa =  * ,Cys
  position -15 of amino acid sequence
  unsure 5: Xaa = Arg,Trp
  position 5 of amino acid sequence
  unsure 55: Xaa = Lys,Thr; position 55 of amino acid sequence; Xaa = Cys,Arg
agaggacagggtagagtcgcagaaaggagagacacacatacatggaaagaggagcyttctccaatcttaatgattcccagctctcagcctcgtttctgmaacccagcctgcaagcaaactgtcctgcttwgggaccctgctgtgtcactctccgcaccagcctttgcctctgctcttcgctctatgamgtcctcccaggctgcacggaaggacgactttctcaggtctcttagtgatggagactcagggacatcagaacacatctcagcggtggtgactagccctcggatttcctgccatggtgctgccattcccaccgcccgtgccctctgcctaygctgttcctgctgcaccgaacgc

SEQ ID NO: 1108 - DNA, 226 bp, Homo Sapiens
  Ovary
  sig_peptide 161..205: Von Heijne matrix; score 3.60; seq PTFLLISDSFLTS/QP
attggcctgctcttcctgatacctacttggtcactacttaattacattttgtttgtgtatcttttttcttcaggctgtaaattctctaaaggcattttgcttattttggtgtcacaattgtttaggccatgcgcctaggtcttcttaaaacacctctctcatggctcctacttttctacttatttctgattcttttctgacttctcagccttcttttttttttttt

SEQ ID NO: 1109 - DNA, 362 bp, Homo Sapiens
  Testis
  sig_peptide 219..275: Von Heijne matrix; score 3.60; seq LSLLGIKIQWCLS/EN
aaaaaatacackgagattatgtacgatttagtgatttggtgggataattataaatcgtggaataatttatatatgtggagtaagaagagaggggtcaaaccttttggtacaagcaacatcttgttgccaccaccttgattttctcataggtgctattgtgtcctaagagtrgracagrsrrgraaacaaagataattaaacacaagtcaggttacaacatgatatctttaattgtactttctctgcttggtatcaagattcagtggtgcttgtcagaaaataccttgttctgtgactctgactatctcttgagtcccaaggctccaattgagcctttatctttcaaccttaccacccagggg

SEQ ID NO: 1110 - DNA, 263 bp, Homo Sapiens
  Ovary
  sig_peptide 129..257: Von Heijne matrix
  score 3.60
  unsure -25: seq LLYFNTFLPRKVA/RV; position -25 of amino acid sequence; Xaa = Glu,Gly
attaagtcctgcattttgtaagaggcaaatggagagtaacagaagagtgtcttttctcctggttttggagtcttgcactggccatgagtgttgkgactgatggtcracccaggcgggcattttaataaatggcctgtgattcttttttgaaagatgctcttccacaagagttaagccagttagrrttcctgtttcctcttgttgatatgagagaagatctcctgtattttaacacgtttttaccaagaaaggtggcacgggtg

SEQ ID NO: 1111 - DNA, 216 bp, Homo Sapiens
  Uterus
  sig_peptide 13..171: Von Heijne matrix; score 3.60; seq FLILHFFPQQIRK/KI
attctcaatcaaatgttgctattgaatgaaaacctcaaagcagaaattcaaaagaatgaagctcaaggcagctgtatcttgtttctgttttgctttgagagtcagaatatgcgatcaaaatctatcttccccttccttatccttcatttttttccccagcagataagaaaaaaaatagtggtgcttcttttaggacttaattctcagaaggcaggg

SEQ ID NO: 1112 - DNA, 125 bp, Homo Sapiens
  Spleen
  sig_peptide 6..83: Von Heijne matrix
  score 3.50
  unsure 2: seq LLPFTFLSLKAFL/QX; position 2 of amino acid sequence; Xaa = Leu,Pro,Ser
agctgatgataagtaagtatgtgcattatagcttgactgacttactattaccttttacattcttaagccttaaagcctttctgcagyyaagagttttaatgtctcttcctcaacacaagccctgg

SEQ ID NO: 1113 - DNA, 194 bp, Homo Sapiens
  Testis
  sig_peptide 42..122: Von Heijne matrix; score 3.50; seq CSLLSSFCALHFG/LK
aatatgtgatcaaacgcccaggagccagctggtgasaaagaatggcgaggacaatgggagttcccagagcatgcaaggccttctgtagcctcctctccagcttctgtgcattacactttgggctcaagaaacagtatggtacttcttacctccatgcctgtgcttatgctagccccttgacctggggtccctgg

SEQ ID NO: 1114 - DNA, 348 bp, Homo Sapiens
  Testis
  sig_peptide 262..306: Von Heijne matrix
  score 3.50
  unsure 2: seq LCFLLPHHRLQEA/RX
  position 2 of amino acid sequence
  unsure 8: Xaa =  * ,Gln; position 8 of amino acid sequence; Xaa = Ile,Met
atttcgcggcgctcgcbgmacyhsgwtgttcagcaccttcggtccggttgaggttgtcaagtcggmccaaacaggttgtttctctgcagtttccaacatggcagggmsgtttaatagacatggataagaagtccactcacagaaatcctgaagatgccagggctggcaaatatgaaggtaaacacaaacgaaagaaaagaagaaagcaaaaccaaaaccagcaccgatcccgacatagatcagtgacgtctttttcttcagatgatcctatgtttccttcttcctcatcatcgtcttcaggaagccagayagattcaagtattgaagatkcttccaagggaaaaatta

SEQ ID NO: 1115 - DNA, 255 bp, Homo Sapiens
  Spleen
  sig_peptide 7..84: Von Heijne matrix; score 3.50; seq QCFFVCFSPKIYG/VI
aataacatgcaagactacgtttcacatgcagtacggcgccactgtcagtgtttttttgtttgtttttcccccaagatttatggcgtaataacatggaccgtcctgataactggagcccgggttctgtcagagccccagaggttgtgggttagacttgatgacataacagcaaatgcagcgtgtggttacagaaagcaagagccgcggaagacgtttgaaaacaattgggaaaatttgtatacggactggaactgg

SEQ ID NO: 1116 - DNA, 224 bp, Homo Sapiens
  Testis
  sig_peptide 120..212: Von Heijne matrix; score 3.50; seq VLLNLALSHFNNC/GL
agatyttataatcttgctacaaagaaagtaggacagtctcagcctttaagaatgtcactataacagttttttttttccttaaggatattttaaacaggaaagtagacaaccgggtaagcatggagtttgctcatgctgccgaatgtgtgtcttttgccctaaatgaaacgcacgttcttctaaatttagccctatcacattttaacaattgtggcctcgcagtg

SEQ ID NO: 1117 - DNA, 276 bp, Homo Sapiens
  Ovary
  sig_peptide 133..222: Von Heijne matrix; score 3.50; seq LLAASWLPRDAPC/EA
acagattgctttccaagctgaacatatgcaactgtattgctaaacttaccaatttcagggaatctgggcgtcaaaagcatccacatccctgcagcaggcccctggggaggtaggcagggtgacagctgggaaatgggraaccagggctttccatacctgtctccttctctcagtgtccaggatcttcttgctgcttcatggctgccccgagatgctccctgtgaggcccccccgggcctgccttcacagacaatgctctgtgcccctggaccaagg

SEQ ID NO: 1118 - DNA, 196 bp, Homo Sapiens
  Ovary
  sig_peptide 68..133: Von Heijne matrix; score 3.50; seq AQLASPLLPGATP/VA
aacaaattgatcttgtgtgatgagtgtaataaagccttccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgtatggg

SEQ ID NO: 1119 - DNA, 145 bp, Homo Sapiens
  Testis
  sig_peptide 41..103: Von Heijne matrix
  score 12.70
  misc_feature 55..94: seq ILFLLSWSGPLQG/QQ; blastn; identity 100; region 1..40
  id AA134726
  misc_feature 89..121: est; blastn; identity 93; region 34..66
  id AA134726
  misc_feature 72..140: est; blastn; identity 95; region 1..69; id R17226; est
agtacgttccttctactctggcaccactctccaggctgccatggggcccagcacccctctcctcatcttgttccttttgtcatggtcgggacccctccaaggacagcagcaccaccttgtggagtacatggaacgccgacacggg

SEQ ID NO: 1120 - DNA, 172 bp, Homo Sapiens
  Ovary
  sig_peptide 86..145: Von Heijne matrix
  score 7.40
  misc_feature 73..169: seq LVFCVGLLTMAKA/ES; blastn; identity 100; region 73..169
  id W25639
  misc_feature 37..81: est; blastn; identity 91; region 38..82
  id W25639
  misc_feature 42..169: est; blastn; identity 100; region 1..128
  id AA040016
  misc_feature 34..169: est; blastn; identity 96; region 23..158
  id R72515
  misc_feature 47..169: est; blastn; identity 99; region 1..123; id T84313; est
aagggggtccaaagtgctcagcccccggggcacagcaggacgtttgggggccttctttcagcaggggacagcccgattggggacaatggcgtctcttggccacatcttggttttctgtgtgggtctcctcaccatggccaaggcagaaagtccaaaggaacacgacccgagg

SEQ ID NO: 1121 - DNA, 193 bp, Homo Sapiens
  Testis
  sig_peptide 53..121: Von Heijne matrix
  score 7.30
  misc_feature 46..192: seq ALSLLLVSGSLLP/GP; blastn; identity 98; region 5..151
  id R14826
  misc_feature 46..192: est; blastn; identity 91; region 129..275
  id W55137
  misc_feature 57..192: est; blastn; identity 91; region 1..136
  id W64115
  misc_feature 57..192: est; blastn; identity 91; region 1..136
  id W75505
  misc_feature 78..192: est; blastn; identity 97; region 1..115; id W20303; est
actcaataaatgttttccgcattaagacgcttcttaggagtcttcatggaggatgtcgggttcgtcgctgcccagcgccctggccctctcgctgttgctggtctctggctccctcctcccagggccaggcgccgctcagaacgagccaaggattgtcaccagtgaagaggtcattattcgagacagccccgtg

SEQ ID NO: 1122 - DNA, 247 bp, Homo Sapiens
  Ovary
  sig_peptide 53..223: Von Heijne matrix
  score 7.10
  misc_feature 71..207: seq VGLAVVSLGGSRG/SG; blastn; identity 100; region 1..137
  id R73005
  misc_feature 80..207: est; blastn; identity 100; region 1..128
  id N26942
  misc_feature 86..207: est; blastn; identity 100; region 1..122
  id W02954
  misc_feature 112..207: est; blastn; identity 100; region 1..96
  id T24907
  misc_feature 137..207: est; blastn; identity 100; region 1..71
  id AA130938
  est
  misc_feature 50: n=a, g, c or t
aactgacaagacgtgggccaagaggggtcaccgcccccggagcggcgcgnasatgatggaagtcgtagtaggaaatggcgtcgtggcattgaggggcatccctcctagaacctccaggaaaagctcgcggaagacgaggttctgcggagagagaggctccaagcagtctgggaagtgtagtccagttggcttagcagtagtttcgttgggggggagccgaggttccgggaaggggctaggccgactg

SEQ ID NO: 1123 - DNA, 373 bp, Homo Sapiens
  Testis
  sig_peptide 200..247: Von Heijne matrix
  score 6.70
  misc_feature 252..375: seq CFSLVLLLTSIWT/TR; blastn; identity 98; region 1..124
  id AA081350
  misc_feature 318..375: est; blastn; identity 98; region 1..58
  id AA046671
  unsure 22: est; position 22 of amino acid sequence; Xaa = Ile,Met
aatttttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaatkatggggatcacccttgtbagcaaaaaggcgaaccagcagctgaatttcacagaagctaag

SEQ ID NO: 1124 - DNA, 438 bp, Homo Sapiens
  Spleen
  sig_peptide 31..93: Von Heijne matrix
  score 5.60
  misc_feature 149..355: seq CLSCLLIPLALWS/II; blastn; identity 100; region 1..207
  id R16604
  misc_feature 354..407: est; blastn; identity 100; region 207..260
  id R16604
  misc_feature 149..362: est; blastn; identity 98; region 1..214
  id N99558
  misc_feature 380..428: est; blastn; identity 93; region 237..285; id N99558; est
gaaatctcccgcagttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctgga

SEQ ID NO: 1125 - DNA, 378 bp, Homo Sapiens
  Uterus
  sig_peptide 133..195: Von Heijne matrix
  score 5.60
  misc_feature 251..376: seq CLSCLLIPLALWS/II; blastn; identity 100; region 1..126
  id R16604
  misc_feature 251..376: est; blastn; identity 96; region 1..126; id N99558; est
atttgttctccaaacagtaaaccagtatttcacactgagattgtcggctgcgggtatattccaattccccgtctcctcatgaatatgaagtgaagggctctgamcctkggaagtggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtggg

SEQ ID NO: 1126 - DNA, 230 bp, Homo Sapiens
  Testis
  sig_peptide 159..209: Von Heijne matrix
  score 5.30
  misc_feature 53..227: seq ILFGVSFVFLTHC/TI; blastn; identity 99; region 190..364
  id AA043641
  misc_feature 92..227: est; blastn; identity 99; region 1..136
  id N98697
  misc_feature 69..102: est; blastn; identity 94; region 393..426
  id AA147010
  misc_feature 53..119: est; blastn; identity 97; region 435..501; id AA142584; est
aaactttagcacatcattttggcattctagaatatttcatctaccatactataattacctgaagacatcaggagaatacaaacttgcaggtgtttttcttggaggtcgttcaatgggctcaagagcagctgcttctgtaatgtgtcacattgagccagatgatggtgatgattttgttcggggtctcatttgtatttcttacccactgcaccatccaaagcagctgcggg

SEQ ID NO: 1127 - DNA, 394 bp, Homo Sapiens
  Testis
  sig_peptide 293..349: Von Heijne matrix
  score 4.40
  misc_feature 310..393: seq VLVSLPHPHPALT/CC; blastn; identity 98; region 1..84
  id HUM426A07B
  est
  misc_feature 119: n=a, g, c or t
  unsure 6: position 6 of amino acid sequence; Xaa = His,Leu
aaaccttgttgctagggaccgggcggtttgcggcaaccgtgggcactgctgaatttgaattgaggggcgagggaaaagttttcctcaggtgtggtggggagagggaggcggatgccggngaaaccgtaggkacgcggtcagaaaggcgacgggctgtcggagttggaaagggacgcctggtttccccccaagcgaaccgggatgggaagtgacttcaatgagattgaacttcagctggattgaaagagaggctagaagttccgcttgccagcagcctccttagtagagcggaatgagtaatacccacacggtgcttgtctcacttccccatccgcacccggccctcacctgctgtcacctcggccwcccacacccggtccgcgctccccgcccg

SEQ ID NO: 1128 - DNA, 473 bp, Homo Sapiens
  Testis
  sig_peptide 99..416: Von Heijne matrix
  score 4.10
  misc_feature 111..321: seq IITLACVPMTSFT/RN; blastn; identity 90; region 1..211
  id N41784
  misc_feature 143..237: est; blastn; identity 97; region 5..99
  id T70115
  est
  misc_feature 363: n=a, g, c or t
  unsure -105: position -105 of amino acid sequence
  unsure -62: Xaa = Leu,Trp
  position -62 of amino acid sequence
  unsure -18: Xaa = Lys,Asn; position -18 of amino acid sequence; Xaa = Ile,Leu,Val
acagcatccttttcaaggatadctgaacagaaccttctaagtctcagacacgtaaacccaagtgtggcaaaggaactcattgctctcgaaatgcatatatgtkggtttatagactgcaaactcaagaraagcccaacactactgtkcaagttccagcctttcttcaagagctggtagatcgggataattccaaatttgaggagtggtgtattgaaatggctgagatgcgtaasaaagtgtggataaaggaaaagcaaaacacgaagaggttaaggagctgtaccaaaggttacctgctggagctgagccctatgagtttgtctctctggaatggctgcaaaagtggttggatgaatcagcaantaccaaacctattgataatcacgcttgcctgtgttcccatgacaagcttcacccggaataaaatatcaattatgaagaggatatctgaatatgcagckgacattttctat

SEQ ID NO: 1129 - DNA, 134 bp, Homo Sapiens
  Testis
  sig_peptide 54..116: Von Heijne matrix
  score 3.90
  misc_feature 63..133: seq LIAVVIIILLIFT/SV; blastn; identity 97; region 152..222
  id AA043974
  misc_feature 98..133: est; blastn; identity 100; region 1..36; id W05501; est
agactttgctgatttagcttatggaagaggaaccagaaatttgtccttgaataatgtttcccgtgttgggctggatcttgatagcagtwgtyatcatcattcttctgatttttacatctgtcacccgatgcctg

SEQ ID NO: 1130 - DNA, 202 bp, Homo Sapiens
  Testis
  sig_peptide 8..64: Von Heijne matrix
  score 3.90
  misc_feature 153..199: seq SVCLCPCLNKGQS/EN; blastn; identity 97; region 1..47
  id R14297
  unsure 37: est; position 37 of amino acid sequence; Xaa =  * ,Trp
aagcaagatgttctcctgctgtatctcagtttgtctatgtccttgtctcaacaaaggccaaagtgagaatctttccagagactgcggwcattggctgaaccctcaccatcgacgcctctggccatttggcagaaggcacccacaggattgtggactcttccaagattcacaatgrtatggtgaatccaaagactggaacggg

SEQ ID NO: 1131 - DNA, 406 bp, Homo Sapiens
  Uterus
  sig_peptide 143..229: Von Heijne matrix
  score 3.50
  misc_feature 338..403: seq LTYLLLLSPIKYP/LD; blastn; identity 98; region 38..103
  id W78795
  misc_feature 338..403: est; blastn; identity 98; region 405..470
  id AA151030
  misc_feature 338..403: est; blastn; identity 98; region 6..71
  id H48640
  misc_feature 338..403: est; blastn; identity 98; region 73..138
  id R99176
  misc_feature 338..403: est; blastn; identity 93; region 48..113; id W79571; est
atcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccacccacg

SEQ ID NO: 1132 - DNA, 210 bp, Homo Sapiens
  Testis
  sig_peptide 70..147: Von Heijne matrix
  score 10.50
  misc_feature complement(118..206): seq LLLALLLPVQVSS/FV; blastn; identity 97; region 144..232
  id T77881
  misc_feature complement(64..118): est; blastn; identity 98; region 231..285
  id T77881
  misc_feature complement(126..206): est; blastn; identity 100; region 139..219; id R01713; est
aaccagccaggagccacccatcctccagcacactgagcagcaagctggacacacggcacactgatccaaatgggtaaggggatggtggcgatgctcattctgggtctgctacttctggcgctgctcctacccgtgcaggtttcttcatttgttcctttaaccagtatgccggaagctactgcagccgaaaccacaaagccctccaatggg

SEQ ID NO: 1133 - DNA, 189 bp, Homo Sapiens
  Testis
  sig_peptide 25..87: Von Heijne matrix
  score 9.50
  misc_feature 2..170: seq LLVLFVLLANVQG/PG; blastn; identity 98; region 4..172; id H56777; est
aagaaaggctggcctctcttcaacatgggatcttctggacttttgagcctcctggtgctattcgtcctcttagcgaatgtccagggacctggtctgactgattggttatttcccaggagatgtcccaaaatcagagaagaatgtgaattccaagaaagggatgtgtgtacaaaggacagacaatgccga

SEQ ID NO: 1134 - DNA, 323 bp, Homo Sapiens
  Ovary
  sig_peptide 90..194: Von Heijne matrix
  score 8.30
  misc_feature 52..258: seq NLLLLHCVSRSHS/QN; blastn; identity 95; region 10..216
  id R60167
  misc_feature 235..319: est; blastn; identity 98; region 194..278
  id R60167
  misc_feature 143..258: est; blastn; identity 92; region 90..205
  id R17888
  misc_feature 55..145: est; blastn; identity 98; region 1..91
  id R17888
  misc_feature 235..316: est; blastn; identity 98; region 183..264
  id R17888
  misc_feature 141..258: est; blastn; identity 91; region 85..202
  id N40052
  misc_feature 56..144: est; blastn; identity 97; region 1..89
  id N40052
  misc_feature 235..319: est; blastn; identity 97; region 180..264
  id N40052
  misc_feature 58..257: est; blastn; identity 98; region 1..200
  id AA039912
  misc_feature 248..319: est; blastn; identity 98; region 190..261
  id AA039912
  misc_feature 50..319: est; blastn; identity 97; region 1..270; id R54127; est
aggaaaggcctgaccacgcagttcttgggtctgtgctgctggcctggggttgtggttgaggccgtgtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgcccccagccggagggccccgggggtgctgcgagctgggaatatggcgacccccactctccggtcatcctctgctcttacctaccttggg

SEQ ID NO: 1135 - DNA, 165 bp, Homo Sapiens
  Testis
  sig_peptide 34..87: Von Heijne matrix
  score 8.30
  misc_feature 31..143: seq LLSLSSLPLVLLG/WE; blastn; identity 99; region 271..383; id W16767; est
aaccagacttctgaccccttgggcaacagccagatggagactggtcgccttttgagcctcagctctcttcctcttgttctcctagggtgggagtacagcagccaaacgctgaacttagtcccatccacttccatcttatcctttgtgcccttcatcccccgagtg

SEQ ID NO: 1136 - DNA, 201 bp, Homo Sapiens
  Ovary
  sig_peptide 25..81: Von Heijne matrix
  score 8.20
  misc_feature 24..203: seq QVLALVLVAALWG/GT; blastn; identity 97; region 1..180
  id HSC1PF091
  misc_feature 114..203: est; blastn; identity 98; region 78..167
  id H03709
  misc_feature 35..107: est; blastn; identity 98; region 1..73; id H03709; est
aaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatg

SEQ ID NO: 1137 - DNA, 462 bp, Homo Sapiens
  Spleen
  sig_peptide 211..387: Von Heijne matrix
  score 8.10
  misc_feature 6..119: seq FLLGISNLSQVRA/SN; blastn; identity 92; region 1..114
  id N83684
  misc_feature 147..241: est; blastn; identity 97; region 112..206
  id N83684
  misc_feature 283..323: est; blastn; identity 100; region 245..285
  id N83684
  misc_feature 327..361: est; blastn; identity 97; region 287..321
  id N83684
  misc_feature 150..299: est; blastn; identity 98; region 177..326
  id H94179
  misc_feature 23..109: est; blastn; identity 90; region 41..127
  id H94179
  misc_feature 17..90: est; blastn; identity 100; region 1..74
  id AA093069
  misc_feature 144..194: est; blastn; identity 90; region 123..173
  id AA093069
  misc_feature 150..249: est; blastn; identity 97; region 198..297
  id T67190
  unsure 23: est; position 23 of amino acid sequence; Xaa = Asn,Thr
agcgggtgttgagagcggtgtggtaggtgttgtagccgctatggtgaagttcgctttgtagcggccccggctagagagttggcctgttccctgcctttgtgacccggaggagcttttggggtgcgtcaagcccctggcctgaggcagcgadctggtttgtggcctgtttgattcctgtcagaggtttgctgacccaagacagtatcgaaaatgcatattaagtcaattattctagagggattcaagtcctatgctcagaggaccgaagtcaatggttttgaccccctcttcaatgctatcactggcttaaatggtagtgggaaatccaacatattggactccatctgctttttgctgggcatctccaacctgtctcaggttcgggcttctaatttacaagatttagtttacaaaaatgggcaggctggtattaccaaagcctctgtgtcaatcamttttgat

SEQ ID NO: 1138 - DNA, 473 bp, Homo Sapiens
  Testis
  sig_peptide 285..341: Von Heijne matrix
  score 8.00
  misc_feature 280..404: seq WGFLCVLFTAVHP/AP; blastn; identity 97; region 165..289
  id N46466
  misc_feature 76..168: est; blastn; identity 98; region 52..144
  id N46466
  misc_feature 405..469: est; blastn; identity 96; region 289..353
  id N46466
  misc_feature complement(405..469): est; blastn; identity 96; region 180..244
  id W86648
  misc_feature complement(343..404): est; blastn; identity 95; region 244..305
  id W86648
  misc_feature complement(297..347): est; blastn; identity 100; region 302..352
  id W86648
  misc_feature 273..358: est; blastn; identity 96; region 38..123
  id W86523
  misc_feature 357..404: est; blastn; identity 91; region 123..170
  id W86523
  misc_feature 405..436: est; blastn; identity 96; region 170..201
  id W86523
  unsure 20: est
  position 20 of amino acid sequence
  unsure 21: Xaa = His,Gln; position 21 of amino acid sequence; Xaa = Ala,Glu,Lys,Pro,Gln,Thr
aagmsaggggaagcgcccaaggtcacacagctgggatgtggcagagctggggttccagctcctgttcccattgctggacagctgccacatctggcacccaatttaggaccccgcggggaggcccaagccccgggggtggcgggggatcctagaggaaagtggcaaggccaggaccctggagcagagccagagtagaaaactgaggctctgagagatgaagctacttgccaaggtcacgcagcacagtcacatcctactgaacatcatcctgttctctgggtggaatgtcaccatcgcccaggtggggatttttgtgtgttttgttcactgctgtacacccagcccccagcacagcgcctgtccaggacaagtgcccagtaaacacttgggaagcaatgcabvmggtcctcccagcagctcctgcaaacagacccccgacccaagcctttccttctgcmtccactgccacaggg

SEQ ID NO: 1139 - DNA, 250 bp, Homo Sapiens
  Testis
  sig_peptide 56..127: Von Heijne matrix
  score 7.80
  misc_feature complement(1..189): seq FLLCLCIAYWAST/AV; blastn; identity 99; region 1..189; id R47502; est
aattctcatcgcgattgcactcatcaaagaagccagcagggctgtgggatacgtcatgtgctccttgctctacccactggtcaccttcttcttgctgtgcctctgcatcgcctactgggccagcactgctgtcttcctgtccacttccaacgaagcggtctataagatctttgatgacagcccctgcccatttactgcgaaaacctgcaacccagagaccttcccctcctccaatgagccccgccatggg

SEQ ID NO: 1140 - DNA, 176 bp, Homo Sapiens
  Spleen
  sig_peptide 24..71: Von Heijne matrix
  score 7.60
  misc_feature complement(51..119): seq FLFFSTLFSSIFT/EA; blastn; identity 100; region 404..472
  id AA099571
  misc_feature complement(118..174): est; blastn; identity 100; region 348..404; id AA099571; est
aaaagctttggagatattgaatcatgttaccatttctgtttttttccaccctgttttcttccatatttactgaagctcagaagcagtattgggtctgcaactcatccgatgcaagtattcatacacctactgtgataaaatgcaatacccaatttcaattaatgttaacccctggg

SEQ ID NO: 1141 - DNA, 383 bp, Homo Sapiens
  Testis
  sig_peptide 126..167: Von Heijne matrix
  score 7.50
  misc_feature 103..248: seq VALNLILVPCCAA/WC; blastn; identity 97; region 12..157
  id W56658
  misc_feature 255..385: est; blastn; identity 99; region 164..294
  id W56658
  misc_feature 18..248: est; blastn; identity 96; region 1..231
  id AA127477
  misc_feature 123..385: est; blastn; identity 98; region 1..263
  id N40410
  misc_feature complement(340..371): est; blastn; identity 93; region 354..385; id R93185; est
aattgtatgttacgatgttgtattgatttttaagaaagtaattkratttgtaaaacttctgctcgtttacactgcacattgaatacaggtaactaattggwwggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctc

SEQ ID NO: 1142 - DNA, 372 bp, Homo Sapiens
  Testis
  sig_peptide 10..168: Von Heijne matrix
  score 7.10
  misc_feature 83..291: seq IAVGLGVAALAFA/GR; blastn; identity 97; region 69..277
  id AA149265
  misc_feature 12..57: est; blastn; identity 95; region 1..46
  id AA149265
  misc_feature 321..351: est; blastn; identity 93; region 310..340
  id AA149265
  misc_feature 81..372: est; blastn; identity 98; region 53..344
  id W39570
  misc_feature 27..57: est; blastn; identity 93; region 2..32
  id W39570
  misc_feature 81..372: est; blastn; identity 98; region 55..346
  id N41332
  misc_feature 24..57: est; blastn; identity 94; region 1..34; id N41332; est
agccttgccatggctgcccgtggtgtcatcgctccagttggcgagagtytgcgctacgctgagtacttgcagccctcggccaaacggccagacgccgacgtcgaccagcagagactggtaagaagtttgatagctgtaggactgggtgttgcagctcttgcatttgcaggtcgctacgcatttcggatctggaaacctctagaacaagttatcacagaaactgcaaagaagatttcaactcctagcttttcatcctactataaaggaggatttgaacagaaaatgagtaggcgagaagctggtcttattttaggtgtaagcccatctgctggcaaggctaagattagaacagctcataggagagtcatgatt

SEQ ID NO: 1143 - DNA, 254 bp, Homo Sapiens
  Testis
  sig_peptide 126..170: Von Heijne matrix
  score 7.10
  misc_feature 3..249: seq KLKLLSLLRPSLC/IP; blastn; identity 100; region 1..247
  id HUM225B05B
  misc_feature 3..135: est; blastn; identity 96; region 1..133
  id HUM224A06B
  misc_feature 131..183: est; blastn; identity 92; region 128..180
  id HUM224A06B
  misc_feature 182..223: est; blastn; identity 95; region 178..219
  id HUM224A06B
  misc_feature complement(2..165): est; blastn; identity 100; region 1..164; id R81598; est
aacacaagcaaaacttttaaatatttgaattgacagttacatgtttcataactttgtatgtctattggttgtgcaggtgtaattttttccctttttgattagggttacaaaatttagagaccagtatgattaagttgaagctccttagcctccttcgacctagtctctgcatacctcaacttttacgtaccaatgctactctgctgttcacaattgcctcatgtaatctgcagattcctgcctccccacgacgg

SEQ ID NO: 1144 - DNA, 143 bp, Homo Sapiens
  Spleen
  sig_peptide 18..77: Von Heijne matrix
  score 6.50
  misc_feature 100..144: seq GLCVLQLTTAVTS/AF; blastn; identity 97; region 95..139
  id T95183
  misc_feature 56..105: est; blastn; identity 90; region 52..101
  id T95183
  misc_feature 100..144: est; blastn; identity 97; region 101..145
  id R48890
  misc_feature 73..105: est; blastn; identity 90; region 75..107
  id R48890
  unsure 12: est; position 12 of amino acid sequence; Xaa = Ala,Thr
aaccttcacagtgtgagatgcctagtgtgaacagtgctggattatgtgtcttgcagttgacaacggcagtraccagtgcctttttactagcaaaagtgaatcctttcgaarcttttctctcaaggggcttttggctatgtgct

SEQ ID NO: 1145 - DNA, 178 bp, Homo Sapiens
  Ovary
  sig_peptide 86..145: Von Heijne matrix
  score 6.40
  misc_feature complement(118..179): seq ALFLLVSXYMIRS/GT; blastn; identity 90; region 296..357
  id T92237
  unsure -6: est; position -6 of amino acid sequence; Xaa = Phe,Leu,Val
acagagamtaacgatgtttcttatttgaatccagtgaaagtactcatgctttgtgttcttgggaattactgagttcaaattcctaatgatgcttgggttacactttgctttgtttctcctagtttctktwtatatgatccggagtggcactggtaataagattgaagaaggtgggcgg

SEQ ID NO: 1146 - DNA, 181 bp, Homo Sapiens
  Testis
  sig_peptide 38..76: Von Heijne matrix
  score 6.40
  misc_feature 32..178: seq MALLLSVLRVLLG/GF; blastn; identity 97; region 2..148
  id H42383
  misc_feature 35..178: est; blastn; identity 93; region 5..148
  id R67703
  misc_feature 145..178: est; blastn; identity 91; region 29..62
  id W90193
  unsure 29: est; position 29 of amino acid sequence; Xaa = Lys,Gln
atcggcggggccaacccacggtggggggagcgcggccatggcgctcctgctttcggtgctgcgtgtactgctgggcggcttcttcgcgctcgtggggttggccaagctctcggaggagatctcggctccagtdtcggagcggatgaatgccctgttcgtrmagtttgctgaggtgctcggg

SEQ ID NO: 1147 - DNA, 156 bp, Homo Sapiens
  Ovary
  sig_peptide 34..84: Von Heijne matrix
  score 6.20
  misc_feature 100..154: seq LWLSLVAWHWGEA/VL; blastn; identity 94; region 111..165
  id HSC2EB021
  misc_feature 100..154: est; blastn; identity 94; region 37..91; id T31104; est
acttttttcacgctactcccccggagtgcttggatgttgaagagtctctggttgagccttgtggcctggcactggggtgaggctgtcctcctctcccctcatctccctgcagcggcagaatggccccgggcagcgtgtgattcgggaggtgaaccg

SEQ ID NO: 1148 - DNA, 254 bp, Homo Sapiens
  Ovary
  sig_peptide 183..227: Von Heijne matrix
  score 6.10
  misc_feature 75..152: seq IVTWLLXSFMSSA/EE; blastn; identity 96; region 109..186
  id R38459
  misc_feature 148..200: est; blastn; identity 100; region 183..235
  id R38459
  unsure -7: est; position -7 of amino acid sequence; Xaa =  * ,Ser
aatactttggcagcttcttcacgtcggtcctctccgcgcgcgggtaggaaccgtccacggccttaaagaagcctcctcaccagccatacttcccattgcctccagctgttgcacggaggtttcacatcatatttccagaaggctcctggaaagagtgaatatgtgtcgcatccagagagctgatggggattgtgacttggctgctgtmatccttcatgtcaagcgcagaagaatctgtgtcagcccgcacacgg

SEQ ID NO: 1149 - DNA, 190 bp, Homo Sapiens
  Uterus
  sig_peptide 80..163: Von Heijne matrix
  score 6.00
  misc_feature 83..175: seq IGLMFLMLGCALP/IY; blastn; identity 98; region 80..172
  id T62095
  misc_feature 37..82: est; blastn; identity 93; region 35..80
  id T62095
  misc_feature 2..36: est; blastn; identity 100; region 1..35
  id T62095
  misc_feature 71..187: est; blastn; identity 99; region 85..201
  id N43024
  misc_feature 4..71: est; blastn; identity 92; region 17..84
  id N43024
  misc_feature 37..187: est; blastn; identity 98; region 26..176
  id W42796
  misc_feature 86..187: est; blastn; identity 92; region 114..215
  id AA030227
  misc_feature 86..187: est; blastn; identity 92; region 51..152; id AA118270; est
gtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggccccccggg

SEQ ID NO: 1150 - DNA, 222 bp, Homo Sapiens
  Ovary
  sig_peptide 121..198: Von Heijne matrix
  score 5.80
  misc_feature complement(139..168): seq VKLVTLSVPTSLA/SS; blastn; identity 93; region 270..299
  id W73179
  misc_feature complement(139..168): est; blastn; identity 93; region 295..324
  id R59325
  misc_feature complement(113..144): est; blastn; identity 93; region 218..249; id R06388; est
atttgttccaaaggttccaattattcaagactgcctttggcttcttttacaacatggatgattctatgttatgggcactgaaactaaaagaaactgtggaaggattggtaccttagagaaatgaaaaagcaaaaacatcagaaattatggtgtatttctgtaaagttagtgacactgagtgtgcccacctctcttgcctcctctttaacctcccctacaggg

SEQ ID NO: 1151 - DNA, 417 bp, Homo Sapiens
  Testis
  sig_peptide 184..303: Von Heijne matrix
  score 5.80
  misc_feature complement(227..414): seq VLFALFVAFLLRG/KL; blastn; identity 99; region 94..281
  id H53025
  misc_feature 131..264: est; blastn; identity 97; region 190..323
  id H52956
  misc_feature 285..318: est; blastn; identity 94; region 347..380
  id H52956
  misc_feature 131..233: est; blastn; identity 97; region 191..293
  id H53024
  misc_feature 227..272: est; blastn; identity 93; region 288..333; id H53024; est
aagtatctcaccatttctttctctttctgaaccacattgggtgccaacagaacttgctctctgttctctttcaaaattaccaacatggaccccacccaattcttcccttggaactaaggaacgcctgactgatcatctgatacagcagtkcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggccatggg

SEQ ID NO: 1152 - DNA, 293 bp, Homo Sapiens
  Uterus
  sig_peptide 21..191: Von Heijne matrix
  score 5.70
  misc_feature 246..293: seq LAICSCLPGPGPA/LP; blastn; identity 95; region 90..137
  id H43824
  misc_feature 246..293: est; blastn; identity 95; region 93..140
  id R73173
  misc_feature 246..293: est; blastn; identity 93; region 112..159; id H26792; est
acctcgctgctcttcatcccatgggtggatttttgcatctccctgctctgtcttcctcctgtctttggacatttccaccgatgtgtgttcgcatcttctcctatgttcctttacctatcctgacccccaaaaccataaatctcatccccgttctggccatctgttcctgtcttcctggccccgggccggcccttcctcttcctgccttcccgaccctccttgtgtcttggtaccactgccccccacagaagaagacaggcatgatggacacggatgatttccgcgcctgcccg

SEQ ID NO: 1153 - DNA, 416 bp, Homo Sapiens
  Testis
  sig_peptide 264..320: Von Heijne matrix
  score 8.00
  misc_feature 259..413: seq WGFLCVLFTAVHP/AP; blastn; identity 99; region 165..319
  id N46466
  misc_feature 55..147: est; blastn; identity 98; region 52..144
  id N46466
  misc_feature 252..338: est; blastn; identity 95; region 38..124
  id W86523
  misc_feature 336..413: est; blastn; identity 97; region 123..200
  id W86523
  misc_feature complement(322..413): est; blastn; identity 98; region 214..305
  id W86648
  misc_feature complement(276..326): est; blastn; identity 98; region 302..352; id W86648; est
gtcacacagctgggatgtggcagagstggggttccagctcctgytcccattgctggacagctgccacatctggcacccaatttaggaccccgcggggaggcccaagccccgggggtggcgggggatcctagaggaaagtggcaaggccaggaccctggagcagagccagagtagaaaactgaggctctgagagatgaagctacttgccaaggtcacgcagcacagtcacatcctactgaacatcatcctgttctctgggtggaatgtcaccatcgcccaggtggggatttttgtgtgtbttgttcactgctgtacacccagcccccagcacagcgcctgtccaggacaagtgcccagtaaacacttgggaagcaatgcaagcgtcctcccagcagctcctgcaaacagaccccatg

SEQ ID NO: 1154 - DNA, 432 bp, Homo Sapiens
  Testis
  sig_peptide 154..381: Von Heijne matrix
  score 5.30
  misc_feature 60..386: seq IILASASFSPNFT/QV; blastn; identity 98; region 7..333
  id AA035208
  misc_feature 400..429: est; blastn; identity 100; region 349..378
  id AA035208
  misc_feature 77..429: est; blastn; identity 99; region 1..353
  id H64963
  misc_feature 50..328: est; blastn; identity 98; region 10..288
  id R97144
  misc_feature 56..393: est; blastn; identity 97; region 3..340
  id N73170
  misc_feature 14..300: est; blastn; identity 98; region 2..288
  id H13072
  unsure -32: est; position -32 of amino acid sequence; Xaa = Ile,Val
agtaaaaaaacactggaataaggaagggctgatgactttcagaagatgaaggtaagtagaaaccgttgatgggactgagaaaccagagtkaaaacctctttggagcttctgaggactcagctggaaccaacgggcacagttggcaacaccatcatgacatcacaacctgttcccaatgagaccatcatagtgctcccatcaaatgtcatcaacttctcccaagcagagaaacccgaacccaccaaccaggggcaggatagcctgaagaaacatctacacgcagarrtcaaagttattgggactatccagatcttgtgtggcatgatggtattgagcttggggatcattttggcatctgcttccttctctccaaattttacccaagtgacttctacactgttgaactctgcttacccattcataggacccggg

SEQ ID NO: 1155 - DNA, 437 bp, Homo Sapiens
  Testis
  sig_peptide 57..329: Von Heijne matrix
  score 4.80
  misc_feature 47..230: seq IILRLPWLNRSQT/VV; blastn; identity 100; region 158..341
  id AA040813
  misc_feature 229..395: est; blastn; identity 99; region 341..507
  id AA040813
  misc_feature 205..429: est; blastn; identity 98; region 111..335
  id H84584
  misc_feature complement(325..422): est; blastn; identity 96; region 225..322
  id AA040149
  misc_feature complement(215..269): est; blastn; identity 98; region 381..435
  id AA040149
  misc_feature complement(279..327): est; blastn; identity 100; region 321..369
  id AA040149
  unsure 32: est; position 32 of amino acid sequence; Xaa = Glu,Val
acgcttcgtcctctgcagtcaagacgctgggcgcgtcgaggactgggatttcaaatatgcgtgcattagagaatgattttttcaattctcccccaagaaaaactgttcggtttggtggaactgtgacagaagtcttgctgaagtacaaaaagggtgaaacaaatgactttgagttgttgaagaaccagctgttagatccagacataaaggatgaccagatcatcaactggctgctagaattccgttcttctgtcatgtacttgacaaaagactttgagcaacttatcagtattatattgagattgccttggttgaatagaagtcaaacagtagtggaagagtatttggcttttcttggtaatcttgtatcagcagagactgttttcctcagaccgtgtctcagcatgattgcttcccattttgwgcctcccgagctg

SEQ ID NO: 1156 - DNA, 244 bp, Homo Sapiens
  Spleen
  sig_peptide 74..166: Von Heijne matrix
  score 4.80
  misc_feature 54..242: seq WAFSCGTWLPSRA/EW; blastn; identity 97; region 12..200
  id R19497
  misc_feature 78..242: est; blastn; identity 98; region 1..165
  id H75597
  misc_feature 84..242: est; blastn; identity 98; region 1..159
  id H93398
  misc_feature 122..243: est; blastn; identity 100; region 1..122; id HUM030E11B; est
atagaagggggtggggccacgtttgcgtccgcgccatcaggcccgagatagcggcgaggtccgctttcagtgtatggttttccctgccaaacggttctgcttggtgccatccatggagggcgtgcgctgggccttttcctgcggcacttggctgccgagccgagccgaatggctgctggcagtgcgatcgattcagcccgaggagaaggagcgcattggccagttcgtctttgcccgggacggg

SEQ ID NO: 1157 - DNA, 373 bp, Homo Sapiens
  Testis
  sig_peptide 95..340: Von Heijne matrix
  score 4.70
  misc_feature 101..273: seq LTCLADLFHSIAT/XK; blastn; identity 92; region 159..331
  id W57194
  unsure 1: est
  position 1 of amino acid sequence
  unsure 6: Xaa = Glu,Gln; position 6 of amino acid sequence; Xaa = Ala,Gly,Val
aagaggagaaggctgggtatgaggaaactgctgtcttttcactggatcagacgtaaatattaactggacctctctttagattctttgctcaataatgaattgttttcagggcaccaatgcctctgctctggaaaaagacattggtccagagcagtttccaatcaatgaacactatttcggattggtcaattttggaaacacatgctactgtaactccgtgcttcaggcattgtactcctgccgtccattccgggagaatgtgttggcatacaaggcccagcaaaagaagaaggaaaacttgctgacgtgcctggcggaccttttccacagcattgccacasagaagaagaaggttgbrtcatcccacctgggg

SEQ ID NO: 1158 - DNA, 184 bp, Homo Sapiens
  Testis
  sig_peptide 20..67: Von Heijne matrix
  score 4.60
  misc_feature 73..182: seq ALRVRXXXFGTRA/CR; blastn; identity 93; region 68..177
  id W60868
  misc_feature 62..182: est; blastn; identity 96; region 1..121
  id C17761
  misc_feature complement(150..182): est; blastn; identity 96; region 185..217
  id W60944
  unsure -8: est
  position -8 of amino acid sequence
  unsure -7: Xaa = Cys,Gly
  position -7 of amino acid sequence
  unsure -6,11: Xaa =  * ,Ser
  position -6, 11 of amino acid sequence
  unsure 18: Xaa = Leu,Val
  position 18 of amino acid sequence
  unsure 30: Xaa = Ser,Thr; position 30 of amino acid sequence; Xaa = His,Gln
aatttccgasccgggcaagatggcagcggcgctgcgcgtgcgtkgttsastgttcgggacgcgggcctgcaggcgccatggtcttcctcaccgcgcastctggctgcggaatcgcgtcascgaccgctactttcggatccaggaggtgctgaagcasgccaggcacttccggggaaggaaaagg

SEQ ID NO: 1159 - DNA, 190 bp, Homo Sapiens
  Testis
  sig_peptide 56..100: Von Heijne matrix
  score 4.60
  misc_feature 35..186: seq LLTHNLLSSHVRG/VG; blastn; identity 97; region 1..152
  id AA058818
  misc_feature 32..135: est; blastn; identity 100; region 1..104
  id T50012
  misc_feature 134..186: est; blastn; identity 98; region 102..154
  id T50012
  misc_feature 56..186: est; blastn; identity 96; region 33..163
  id H79942
  misc_feature 21..135: est; blastn; identity 93; region 3..117
  id AA058605
  misc_feature 134..186: est; blastn; identity 98; region 115..167
  id AA058605
  misc_feature 48..186: est; blastn; identity 99; region 1..139; id R37526; est
ctaatcgaaaagggggattttccggttccggcctggcgagagtttgtgcggcgacatgaaactgcttacccacaatctgctgagctcgcatgtgcggggggtggggtcccgtggcttccccctgcgcctccaggccaccgaggtccgtatctgccctgtggaattcaaccccaacttcgtggcgcgacgg

SEQ ID NO: 1160 - DNA, 189 bp, Homo Sapiens
  Testis
  sig_peptide 7..129: Von Heijne matrix
  score 4.60
  misc_feature 54..186: seq VSAGSLLLPAPQA/EX; blastn; identity 94; region 45..177
  id HSC2KH091
  misc_feature 9..52: est; blastn; identity 95; region 1..44
  id HSC2KH091
  misc_feature 82..117: est; blastn; identity 97; region 1..36
  id AA090704
  misc_feature 129..186: est; blastn; identity 93; region 36..93
  id AA126596
  misc_feature 93..131: est; blastn; identity 94; region 1..39
  id AA126596
  misc_feature 122..181: est; blastn; identity 91; region 40..99
  id AA090640
  misc_feature 88..117: est; blastn; identity 96; region 8..37
  id AA090640
  misc_feature 99..186: est; blastn; identity 95; region 1..88
  id T36119
  unsure -39: est
  position -39 of amino acid sequence
  unsure 2: Xaa = Phe,Tyr
  position 2 of amino acid sequence
  unsure 6: Xaa = Asp,Glu
  position 6 of amino acid sequence
  unsure 7: Xaa =  * ,Arg,Trp; position 7 of amino acid sequence; Xaa = Ile,Val
aacgggatgggatwcttctcacggcgcacgttctgtgggcggagtgggcggagctgccggggtcagttggtccaagtgtcccggcctgaggtgtcggccggatccctccttctcccggcgcctcaagcggaagascattcctcawgrrttttgtatccaaggcccaaaagtttgttacccaagatgggg

SEQ ID NO: 1161 - DNA, 237 bp, Homo Sapiens
  Ovary
  sig_peptide 1..165: Von Heijne matrix
  score 4.60
  misc_feature 132..235: seq CALSLPDAPGASG/GR; blastn; identity 99; region 94..197
  id R36207
  misc_feature 37..110: est; blastn; identity 100; region 1..74
  id R36207
  misc_feature 41..194: est; blastn; identity 94; region 1..154
  id AA090796
  misc_feature 107..235: est; blastn; identity 96; region 15..143
  id AA091961
  misc_feature 141..193: est; blastn; identity 96; region 33..85
  id AA091520
  misc_feature 190..237: est; blastn; identity 97; region 81..128
  id AA091520
  misc_feature 109..142: est; blastn; identity 100; region 2..35; id AA091520; est
atggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccag

SEQ ID NO: 1162 - DNA, 216 bp, Homo Sapiens
  Ovary
  sig_peptide 163..204: Von Heijne matrix
  score 4.50
  misc_feature 144..213: seq TLLSFAALTAAFS/VL; blastn; identity 97; region 1..70
  id N53816
  misc_feature 21..63: est; blastn; identity 100; region 1..43; id T34269; est
aagcgccggahgcggtgaggcacagatgagtaacgtgaatttgtccgtctccgacttctggaggtaaggcggtcgtcagcctatctcttctgctggctgggctcaatgccgcgggtgagcgttcggccgaggctgctcctacccttgagtgatgtgccttgaatgacgctgctttcattcgctgctctcacggctgctttctccgtcctccccaag

SEQ ID NO: 1163 - DNA, 269 bp, Homo Sapiens
  Ovary
  sig_peptide 36..98: Von Heijne matrix
  score 4.40
  misc_feature 46..271: seq GLSKLQFAPFSSA/LD; blastn; identity 98; region 36..261
  id HSC3IF011
  misc_feature 11..44: est; blastn; identity 100; region 2..35
  id HSC3IF011
  misc_feature 50..271: est; blastn; identity 98; region 39..260
  id N28442
  misc_feature 18..234: est; blastn; identity 98; region 1..217
  id HUM517C01B
  misc_feature 125..215: est; blastn; identity 98; region 1..91
  id T77607
  misc_feature 217..271: est; blastn; identity 94; region 92..146
  id T77607
  est
  misc_feature 10: n=a, g, c or t
  unsure 38: position 38 of amino acid sequence; Xaa = Leu,Met
agtggttgcnggaagttgagcggcggcaagaaataatggcggcagctacgggggatcctggactctctaaactgcagtttgccccttttagtagtgccttggatgttgggttttggcatgagttgacccagaagaagctgaacgagtatcggctggatgaagctcccaaggacattaagggttattactacaatggtgactctgctgggmtgccagctcgcttaacattggagttcagtgcttttgacatgagtgctcccaccccaagc

SEQ ID NO: 1164 - DNA, 145 bp, Homo Sapiens
  Spleen
  sig_peptide 50..130: Von Heijne matrix
  score 4.40
  misc_feature 39..143: seq LSKSLLLVPSXLS/LL; blastn; identity 96; region 50..154
  id R50695
  misc_feature 3..45: est; blastn; identity 90; region 15..57
  id R50695
  misc_feature 81..143: est; blastn; identity 96; region 104..166
  id R94786
  misc_feature 81..143: est; blastn; identity 96; region 105..167
  id T98442
  unsure -3: est
  position -3 of amino acid sequence
  unsure 3: Xaa = Ala,Thr; position 3 of amino acid sequence; Xaa = Pro,Arg
aagcttcccctcccccggcgccctctggggctccgagcccggcgggaccatgttcaccagcaccggctccagtgggctctacaaggcgcctctgtcgaagagccttctgctggtccccagtrccctctccctcctgcscgcccag

SEQ ID NO: 1165 - DNA, 427 bp, Homo Sapiens
  Testis
  sig_peptide 179..298: Von Heijne matrix
  score 4.30
  misc_feature 137..291: seq ITLVSAAPGKVIC/EM; blastn; identity 99; region 138..292
  id AA121372
  misc_feature 6..91: est; blastn; identity 97; region 1..86
  id AA121372
  misc_feature 318..397: est; blastn; identity 98; region 322..401
  id AA121372
  misc_feature 95..132: est; blastn; identity 100; region 94..131
  id AA121372
  misc_feature 284..313: est; blastn; identity 90; region 286..315
  id AA121372
  misc_feature 2..102: est; blastn; identity 98; region 15..115
  id T53974
  misc_feature 150..258: est; blastn; identity 92; region 167..275
  id T53974
  misc_feature 95..171: est; blastn; identity 97; region 111..187
  id T53974
  misc_feature 2..102: est; blastn; identity 98; region 15..115
  id R09314
  misc_feature 95..171: est; blastn; identity 97; region 111..187
  id R09314
  misc_feature 150..222: est; blastn; identity 90; region 167..239; id R09314; est
aaaatcgcggaccaccggggctgccakctcgcctgactcccggcctcttgcgctcctaggggcggagaagggtgcgggctcttcgccctttgtgtccttctttcactaacttctggactttccagctcttccgaagttcgttcttgcgcaaagcccaaaggctggaaaaccgtccacgatgaccagcatgactcagtctctgcgggaggtgataaaggccatgaccaaggctcgcaattttgagagagttttgggaaagattactcttgtctctgctgctcctgggaaagtgatttgtgaaatgaaagtagaagaagagcataccaatgcaataggcactctccacggcggtttgacagccacgttagtagataacatatcaacaatggctctgctatgcacggaaaggggagcacccggagtcagt

SEQ ID NO: 1166 - DNA, 332 bp, Homo Sapiens
  Spleen
  sig_peptide 75..293: Von Heijne matrix
  score 4.30
  misc_feature 2..285: seq DIILSGLVPGSTT/LH; blastn; identity 98; region 8..291
  id T31110
  misc_feature 278..331: est; blastn; identity 96; region 285..338
  id T31110
  misc_feature 2..329: est; blastn; identity 98; region 6..333
  id T08844
  misc_feature 2..329: est; blastn; identity 98; region 7..334
  id T35807
  misc_feature 9..331: est; blastn; identity 98; region 1..323
  id T33763
  misc_feature 15..331: est; blastn; identity 99; region 1..317
  id AA132848
  unsure -14: est; position -14 of amino acid sequence; Xaa = Phe,Leu,Val
aagcgagcccaggcggcagtcttgattcccttttggccagcagtttttaggtctgtcagtactgcactgcaagaatggcagattttgggatctctgctggccagtttgtggcagtsgtctgggataagtcatccccagtggaggctctgaaaggtctggtggataagcttcaagcgttaaccggcaatgagggccgcgtgtctgtggaaaacatcaagcagctgttgcaatctgcccacaaagaatccagcbttgacattattttgtcaggtttagtcccaggaagcaccactctgcacagtgctgagattttggctgaaatcgcccgggtg

SEQ ID NO: 1167 - DNA, 131 bp, Homo Sapiens
  Ovary
  sig_peptide 84..125: Von Heijne matrix
  score 4.20
  misc_feature 36..128: seq GILLGLLLLGHLT/VR; blastn; identity 100; region 13..105; id AA115592; est
aacagacgctggcggccaccagaagtttgagcctctttggtagcaggaggctggaagaaaggacagaagtagctctggctgtgatggggatcttactgggcctgctactcctggggcacctaacagtgaga

SEQ ID NO: 1168 - DNA, 486 bp, Homo Sapiens
  Testis
  sig_peptide 55..111: Von Heijne matrix
  score 4.10
  misc_feature 13..53: seq LLLGQRCSLKVSG/QE; blastn; identity 90; region 1..41; id AA063860; est
aaatcttcagggcagctcccagagcatggatccctcctgattccactcagcccgatgttcctcacagtcaagctgctcctgggccagagatgcagtctgaaggtgtcagggcaagagagtgtagccacgctgaagagactggtgtccaggcggctgaaggtgcctgaggagcagcagcacctgcttttccgtggccagctcctggaggatgacaagcacctctctgactactgcattgggcccaatgcctctatcaatgtcatcatgcagcccttggagaagatggcgctaaaggaggcccaccagccgcagacccagcccctgtggcaccagctgggactggtcctagctaaacactttgaaccacaggatgccaaggccgtgctgcagctgctaaggcaggagcacgargagcgcctgcagaagataagcctggagcacctggagcagctggcccagtacctcctggcagaggagctcacgtgg

SEQ ID NO: 1169 - DNA, 411 bp, Homo Sapiens
  Testis
  sig_peptide 94..189: Von Heijne matrix
  score 4.10
  misc_feature complement(195..411): seq RLLSSLLLTMSNN/NP; blastn; identity 99; region 86..302; id AA062591; est
ggcgacgccgccattttggagtcttccctaaggatcctctaccggcttttcgagtcagtgctgccgccgctgcccgcggctttgcagagcaggatgaatgtgatagaccacgtgcgggacatggcggccgcggggctgcactccaacgtgcggctcctcagcagcttgttacttacaatgagtaataacaaccctgagttattctccccacctcagaagtaccagcttttggtgtatcatgcagattctctctttcatgataaggaatatcggaatgctgtgagtaagtataccatggctttacagcagaagaaagcgctaagtaaaacttcaaaagtgagaccttcaactggaaattctgcatctactccacaaagtcagtgtcttccatctgaaattgaagtgaaatac

SEQ ID NO: 1170 - DNA, 232 bp, Homo Sapiens
  Testis
  sig_peptide 56..178: Von Heijne matrix
  score 4.10
  misc_feature complement(184..228): seq RVLCPLLXAAAAP/KR; blastn; identity 100; region 99..143
  id AA122158
  unsure -6: est; position -6 of amino acid sequence; Xaa =  * ,Leu
aagtagctctctaggcctgggkrccggagggagggaggcgggcagagkwggggagatgggcacccccagtctttccatcctcctcataggggcacccgaatcccctattccttatttcccctatcactcaggcactggcagggtcctttgcccactcctgtwggccgctgcggctccaaagcgagatgtgcctgagacaggtttgaccaggcaactgaaaagacatcctggg

SEQ ID NO: 1171 - DNA, 216 bp, Homo Sapiens
  Testis
  sig_peptide 46..123: Von Heijne matrix
  score 3.90
  misc_feature 28..211: seq HALFVLCLLYAMS/HN; blastn; identity 98; region 149..332
  id H15076
  misc_feature 28..139: est; blastn; identity 98; region 147..258
  id R18367
  misc_feature 138..179: est; blastn; identity 92; region 258..299; id R18367; est
aaataattgattccctgtgtctggaatacctgacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgcatggg

SEQ ID NO: 1172 - DNA, 103 bp, Homo Sapiens
  Spleen
  sig_peptide 32..73: Von Heijne matrix
  score 3.80
  misc_feature complement(2..103): seq FIVLSMWLCCGFE/IL; blastn; identity 98; region 148..249; id HSB79F042; est
aacttggtgactctaggtgactggtcgacagatgttcattgtactatcaatgtggctttgctgtgggtttgaaattttgcaaactaagagttgggtggcaggg

SEQ ID NO: 1173 - DNA, 351 bp, Homo Sapiens
  Spleen
  sig_peptide 280..324: Von Heijne matrix
  score 3.80
  misc_feature complement(184..281): seq VVILSSXVPLAAM/GV; blastn; identity 93; region 2..99
  id T07232
  misc_feature complement(103..170): est; blastn; identity 95; region 113..180
  id T07232
  misc_feature 42..106: est; blastn; identity 96; region 20..84
  id AA099117
  est
  misc_feature 261: n=a, g, c or t
  unsure -7: position -7 of amino acid sequence; Xaa = Ala,Val
agaaggcgggaaaatggcggattcctcggggcgaggcgctgggaagcctgcaaccggccccacaaattctagcagtgccaagaagaaggataaaagagttcaaggtaagcagtgtcaggatctctttaaggaacatggttttcttctttcattacgtgcttttggaggaagaaaaaaacaggccagagaagggggcctgtggctttacttccttgtagtcacacctgtggggattctgggtctggccatcccagccctgbngcgagggctgtgtcaggaatggtggtggtcattttgagcagtgyagttcccttggcagccatgggggtcatgggctgtgtccgggtgtgg

SEQ ID NO: 1174 - DNA, 201 bp, Homo Sapiens
  Ovary
  sig_peptide 1..45: Von Heijne matrix
  score 3.80
  misc_feature 16..62: seq AECSSLLHPSVRG/SI; blastn; identity 97; region 463..509; id AA069619; est
atgttggcagaatgcagttccttactgcatccatcagttagaggctcgatcccagaggccacctgccgtgtcctgccatgtggccctctccacaacatggcagtttgctcttgcaaggctagcaggagcttctactgcaacttcagatctctccgacttgctgtctctgacttcttgattcttttccaaaaggggctaggg

SEQ ID NO: 1175 - DNA, 146 bp, Homo Sapiens
  Ovary
  sig_peptide 54..98: Von Heijne matrix
  score 3.80
  misc_feature 76..141: seq MARLLGLCAWARK/SV; blastn; identity 90; region 50..115
  id R25850
  misc_feature 89..141: est; blastn; identity 96; region 49..101
  id N44651
  misc_feature 85..141: est; blastn; identity 91; region 38..94; id N31513; est
aactctgtcacctccgctggaaggagtggaacccagacttgctggtctgatccatgcagatggccaggctgctaggcctctgtgcctgggcacggaagtcggtgcggatggccagctccaggatgacccgccgggacccgccaagg

SEQ ID NO: 1176 - DNA, 231 bp, Homo Sapiens
  Uterus
  sig_peptide 91..219: Von Heijne matrix
  score 3.80
  misc_feature complement(44..83): seq LISVLYLIPKTLT/TN; blastn; identity 97; region 313..352
  id R56475
  misc_feature complement(73..226): est; blastn; identity 95; region 136..289
  id T05392
  misc_feature complement(73..226): est; blastn; identity 93; region 161..314
  id HUM030E12A
  misc_feature complement(72..226): est; blastn; identity 92; region 161..315
  id HUM016H07A
  misc_feature complement(181..226): est; blastn; identity 97; region 168..213
  id H08767
  misc_feature complement(39..77): est; blastn; identity 92; region 326..364; id H08767; est
aacaaaaggagagttttataattcactttaaaaggagatttgatggtaaagtttaaagattaaaatattttgttcttcaattacagagcgatgaccccacagtatctgcctcacggtggaaaataccaagttcttggagattactctttggcagtggtcttccccctgcacttttctgatctaatttctgttttataccttatacccaaaacacttactaccaacagccgg

SEQ ID NO: 1177 - DNA, 361 bp, Homo Sapiens
  Spleen
  sig_peptide 17..85: Von Heijne matrix
  score 3.70
  misc_feature 53..342: seq FLPPLXRAFACRG/CQ; blastn; identity 96; region 19..308
  id C18012
  misc_feature 123..349: est; blastn; identity 96; region 112..338
  id AA058608
  misc_feature 22..83: est; blastn; identity 91; region 12..73
  id AA058608
  misc_feature 103..331: est; blastn; identity 92; region 87..315
  id N42002
  misc_feature 19..87: est; blastn; identity 97; region 1..69
  id R13667
  misc_feature 139..361: est; blastn; identity 100; region 25..247
  id AA151008
  unsure -8: est; position -8 of amino acid sequence; Xaa = Cys,Ser
aagggggcgtggggccatggtggtcttgcgggcggggaagaagacctttctcccccctctmwgccgcgccttcgcctgccgcggctgtcaactcgctccggagcgcggcgccgagcgcagggatacagcgcccagcggggtctcaagattctgccctccaagaaagtcttgccatgattggataggacccccagataaatattcaaaccttcgacctgttcacttttacatacctgaaaatgaatctccattggaacaaaagcttagaaaattaagacaagaaacacaagaatggaatcaacagttctgggcaaaccagaatttgacttttagtaaggaaaaagaagaatttattcactca

SEQ ID NO: 1178 - DNA, 113 bp, Homo Sapiens
  Testis
  sig_peptide 15..74: Von Heijne matrix
  score 3.60
  misc_feature 11..113: seq AHLCSDSLPESQQ/QD; blastn; identity 99; region 2..104; id N76875; est
aagagagaaccgccatgaagagagaagggggtgccgcccacctctgctccgacagcctcccggagtcccagcagcaagacggcaaccacgcacccaacttctccagccacggc

SEQ ID NO: 1179 - DNA, 342 bp, Homo Sapiens
  Testis
  sig_peptide 205..327: Von Heijne matrix
  score 3.60
  misc_feature 255..343: seq PYSLAACPCGSQG/GV; blastn; identity 98; region 12..100; id AA026923; est
accgagaagccctcacagatgcagatgactttggcctacagttcccgctggacctggatgtgagggtgaaggctgtgctgctgggagccacattcctcattgactacatgttctttgagaagcgaggaggcgctgggccctctgccatcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgaga

SEQ ID NO: 1180 - DNA, 420 bp, Homo Sapiens
  Spleen
  sig_peptide 109..162: Von Heijne matrix
  score 3.50
  misc_feature complement(1..300): seq ALEVIVTLSETAA/AM; blastn; identity 100; region 1..300
  id H13499
  misc_feature complement(1..268): est; blastn; identity 100; region 1..268
  id W40371
  misc_feature complement(1..93): est; blastn; identity 98; region 1..93; id H04223; est
aaatccctcgttgagattgcagatactgttccaaagtatttgcgtcctcacttggaagcaactctacagctaagtctaaagttgtgtggagacactagcctcaacaatatgcaacgccagcttgcccttgaagtgatcgtcaccctctctgagactgcagctgctatgttaagaaaacataccaatattgttgcacagactattcctcagatgttagcaatgatggttgatttggaagaagatgaggactgggcaaatgcagatgaactagaagatgatgattttgacagcaatgcagttgcaggcgagagtgctctagatcgaatggcttgcggacttggtggaaagctcgttctgccgatgatcaaggaacacattatgcaaatgcttcaaaatcgtaagctgtgtccttcaatgcta

SEQ ID NO: 1181 - DNA, 392 bp, Homo Sapiens
  Testis
  sig_peptide 147..374: Von Heijne matrix
  score 3.50
  misc_feature 177..348: seq LASASELPLGSRP/AP; blastn; identity 100; region 266..437
  id N32722
  misc_feature 52..175: est; blastn; identity 94; region 142..265
  id N32722
  misc_feature 3..41: est; blastn; identity 100; region 1..39
  id N32722
  misc_feature 36..387: est; blastn; identity 96; region 12..363
  id W32042
  misc_feature 177..348: est; blastn; identity 100; region 134..305
  id R55254
  misc_feature 99..175: est; blastn; identity 100; region 57..133
  id R55254
  misc_feature 44..102: est; blastn; identity 91; region 1..59
  id R55254
  misc_feature 356..387: est; blastn; identity 90; region 315..346
  id R55254
  misc_feature 177..334: est; blastn; identity 100; region 149..306
  id W37647
  misc_feature 38..175: est; blastn; identity 94; region 11..148
  id W37647
  misc_feature 38..174: est; blastn; identity 95; region 8..144
  id R50622
  misc_feature 174..295: est; blastn; identity 99; region 143..264; id R50622; est
aacttcctgtgagcccggcggtgacaacggcaacatggcccgtgaacggagctgaagtcgacgacttctcctrgrarmccccgactgaggcggagacgaaggtgctgcaggcgcgacgggagcggcaagatcgcatctcccggctcatgggcgactatctgctgcgcggttaccgcatgctgggcgagacgtgtgcggactgcgggacgatcctcctccaagacaaacagcggaaaatctactgcgtggcttgtcaggaactcgactcagacgtggataaagataatcccgctctgaatgcccaggctgccctctcccaagctcgggagcaccagctggcctcagcctcagagctccccctgggctctcgacctgcgccccaaccccacggg

SEQ ID NO: 1182 - DNA, 234 bp, Homo Sapiens
  Ovary
  sig_peptide 112..156: Von Heijne matrix
  score 8.10
  misc_feature 61..232: seq LLYLLVPALFCRA/GG; blastn; identity 100; region 1..172
  id HSC1R
  misc_feature 72..232: vrt; blastn; identity 100; region 24..184
  id HUMC1R
  misc_feature 109..232: vrt; blastn; identity 92; region 1..124
  id T74375
  misc_feature 98..141: est; blastn; identity 93; region 1..44; id T64778; est
aactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacacg

SEQ ID NO: 1183 - DNA, 302 bp, Homo Sapiens
  Testis
  sig_peptide 78..251: Von Heijne matrix
  score 4.00
  misc_feature 87..300: seq LAAVSPLVRSLIS/SN; blastn; identity 98; region 1..214
  id HSCALICIN
  unsure -49: vrt
  position -49 of amino acid sequence
  unsure -48: Xaa = Asp,His,Tyr; position -48 of amino acid sequence; Xaa = Asp,Asn
aaatctgatcccacaggcctgagaaagtctgctctccagwacctgctgctgatctgtttcagccgacaagaggcaccatgaaattggaattcacggagaaaaacbacratagcttcgtgctgcaraacctgaacagacagaggaaacgcaaagagtactgggacatggccctgagtgtggacaaccacgtcttctttgcacatcgcaatgtgctggctgctgtctccccactggtgaggagcctcatctccagcaatgacatgaagaccgctgatgagcttttcatcaccattgacaccaag

SEQ ID NO: 1184 - DNA, 352 bp, Homo Sapiens
  liver
  sig_peptide 65..124: Von Heijne matrix
  score 15.80
  misc_feature 49..196: seq LLLLLLLRHGAQG/KP; blastn; identity 97; region 12..159
  id AA232452
  misc_feature 195..337: est; blastn; identity 96; region 157..299
  id AA232452
  est
  misc_feature 31: n=a, g, c or t
  unsure 70: position 70 of amino acid sequence; Xaa = Glu,Gly
acacatttgcgggaacgcagagcggagcgtnggagagcggasrwagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgrggggacggcaacggctggg

SEQ ID NO: 1185 - DNA, 247 bp, Homo Sapiens
  Lung (cells)
  sig_peptide 158..241: Von Heijne matrix; score 11.40; seq LLLILFLYGLCSG/WR
ctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaaaatctgtaaaaactgggtcagttttttggacaatgtgctgctgcttatcctatttctatatggtctctgctcggggtggcgg

SEQ ID NO: 1186 - DNA, 216 bp, Homo Sapiens
  Large intestine
  sig_peptide 61..114: Von Heijne matrix; score 11.10; seq LLALLCASASGNA/IQ
atataaaacatctggaagtttccagggggctgctttgcatctgaaactgtcagccccagaatgttgacagtcgctctcctagcccttctctgtgcctcagcctctggcaatgccattcaggccaggtcttcctcctatagtggagagtatggdctggtggtggaaagcgattctctcattctggcaaccagttggacggccccatcaccgcccacg

SEQ ID NO: 1187 - DNA, 202 bp, Homo Sapiens
  Pancreas
  sig_peptide 107..145: Von Heijne matrix; score 10.40; seq MVLLLCLSCLIFS/CL
aagattcaggccctcagcaaacaaggaacctggaaaatgtaaccctgaatgcacggtggggaggacatggcaagagaaaagcggcaggaataaagtgattttctgaatggtcttgcttctttgtctatcttgtctgattttctcctgtctgaccttttcctggttaaaaatctgggggaaaatgacggactccaagccgatg

SEQ ID NO: 1188 - DNA, 290 bp, Homo Sapiens
  Liver
  sig_peptide 21..83: Von Heijne matrix; score 10.00; seq LWALAMVTRPASA/AP
aataccttagaccctcagtcatgccagtgcctgctctgtgcctgctctgggccctggcaatggtgacccggcctgcctcagcggcccccatgggcggcccagaactggcacagcatgaggagctgaccctgctcttccatgggaccctgcagctgggccaggccctcaacggtgtgtacaggaccacggagggacggctgacaaaggccaggaacagcctgggtctctatggccgcacaatagaactcctggggcaggaggtcagccggggccgggatgcagcccagggc

SEQ ID NO: 1189 - DNA, 259 bp, Homo Sapiens
  Lung (cells)
  sig_peptide 128..250: Von Heijne matrix; score 9.40; seq LLPLWVFLPLSLG/PP
ataaggaataagcaatgttttaaaaccactcaaaatgttcaactgttgccaaaagatgctacggagctctccctaagcccgtggcccaccctaaatgtaacaggcccatgtttacaaacccaaatccatgcatctcagaggctcccacacatatcctagctgtccctcctcagaactccgtttggacagtctctggcagcatcaccggcagctgctgcctctctgggtgttcctgccactcagcctgggcccccctggg

SEQ ID NO: 1190 - DNA, 292 bp, Homo Sapiens
  Lung
  sig_peptide 62..139: Von Heijne matrix
  score 9.20
  unsure 3: seq FLLMTLLLGGLTG/VA
  position 3 of amino acid sequence
  unsure 10: Xaa = Gly,Val
  position 10 of amino acid sequence
  unsure 23: Xaa = Ile,Val
  position 23 of amino acid sequence
  unsure 32: Xaa =  * ,Lys,Ser,Thr
  position 32 of amino acid sequence
  unsure 35: Xaa = Ser,Thr
  position 35 of amino acid sequence
  unsure 42: Xaa = His,Pro; position 42 of amino acid sequence; Xaa = Phe,Leu
aavagtctgcrrtcttcccagcacagacgtttggacagagcaggctcctaaggtctccagaatgcccgtgccagcmtcctggccccaccttcctagtcctttcctgctgatgacgctactgctggggggactcacaggggtagctgkygaggaagagctgcaggtgrttcagcctgacaagtccatatcagttgcagctggaaagwmggccactctgcactgcactgtgacwwccctgatccmtgtggggcccatccagtggttmagaggagctggaccaggccgggaatta

SEQ ID NO: 1191 - DNA, 319 bp, Homo Sapiens
  Large intestine
  sig_peptide 41..109: Von Heijne matrix; score 9.10; seq LVAMLLLVFPTVS/RS
aactaccccggtagcctgacagcaggagctcgagagaagcatggctcagcggtgcgtttgcgtgctggccctggtggctatgctgctcctagttttccctaccgtctccagatcgatgggcccgaggagcggggagcatcaaagggcgtcgcgaatcccttctcagttcagcaaagaggaacgcgtcgcgatgaaagaggcgctgaaaggtgccatccagattccaacagtgacttttagctctgagaagtccaatactacagccctggctgagttcggaaatacattcataaagtctttcctacagtggtcagcaccg

SEQ ID NO: 1192 - DNA, 307 bp, Homo Sapiens
  Lung (cells)
  sig_peptide 251..298: Von Heijne matrix; score 9.00; seq LISFLLLLLLLLP/AR
acaagtttatataacataatagtttcaagggttttgccacttaattatactaagttacttaacctctcaatgccttatctgtagattttgtttttgatagggtgggatagtaatagtaactacaaggtttcacaaggttgtgaaattgaatgagaaatacatggcactttaacaagtggcaggatagttcagacggtttcacaaggttgtgaaattgaatgagaaatacatggcactttaacaagtcactatggattatttaatttcttttcttcttcttctgctgctgcttctccctgcccggggg

SEQ ID NO: 1193 - DNA, 395 bp, Homo Sapiens
  Colon
  sig_peptide 132..383: Von Heijne matrix; score 8.90; seq LLGVLGIFGLTFA/FI
agagtgcctcaagggcagaatggaatgagcagaaccctttggtttcccgggaagagctctcaaccttgagtcaggaagactgatttctcctcccagctccgcaggaacatggaactgtgatcaggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcgga

SEQ ID NO: 1194 - DNA, 294 bp, Homo Sapiens
  Large intestine
  sig_peptide 82..138: Von Heijne matrix
  score 8.90
  seq WLFLVIFIKGVQC/QE
  misc_feature 236: n=a, g, c or t
  unsure 33: position 33 of amino acid sequence; Xaa = Cys,Phe,Ser,Tyr
agctctgggagaagagccccagccccagcaattcccaggagattccattcggtgatcagcgctgaacacagaggactcaccatggagtctgggctgagctggcttttccttgttatttttataaaaggtgtccagtgtcaggagcagctggtggaatctgggggaggcgtggtcaagcctggagggtccctgcgactctcctgtgaagcctctggatttactttcagtgacttctncatgatgtggatccggcagactccagggaagggtctggagtatgtgggcatacatcag

SEQ ID NO: 1195 - DNA, 177 bp, Homo Sapiens
  Lung (cells)
  sig_peptide 115..168: Von Heijne matrix; score 8.60; seq VLLHVAFLPGRFG/RP
ttcttaagattccatgagttgactagttcaattctgttccatggggtgttggctggtccctgtgttcagttggtgccggggctgggctggaaggtccaagacatcttttctcacatgtctggtacctcagtgcttctccacgtggcctttctacctggcaggtttgggcgccctctg

SEQ ID NO: 1196 - DNA, 251 bp, Homo Sapiens
  Lung (cells)
  sig_peptide 93..143: Von Heijne matrix; score 8.60; seq LLPVSLLLSVAVS/AI
aattctgtctcactggagaggaggcagggacagacccagcagcacccacctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacgacgg

SEQ ID NO: 1197 - DNA, 249 bp, Homo Sapiens
  Colon
  sig_peptide 160..204: Von Heijne matrix; score 8.60; seq ICHVSLLLQLCSS/CK
aatccattgttttccctagcagtgtggggctctctgacatgcttgttggtcttggaggggttctgagaggctctccctagtcttaagtgcttctgtcttaccagaccttccttctgtcccctcacttaacagaccatctgctccggccaccattcccacatgcacatttgtcatgtgtctctactgctgcagctttgctcatcttgcaagaagtccccactcaaacttctgctacagaaagcccaaagg

SEQ ID NO: 1198 - DNA, 167 bp, Homo Sapiens
  Liver
  sig_peptide 57..155: Von Heijne matrix; score 8.20; seq LLCSLLFSFPFLC/HP
catcatgaatatctatccccagtcctccactcttgactccctcttggagtggatagatgatctttgctgacaggacacactccagcgctttcaccctgatgaggtcctattctttgcttttgtgctcactcttgttctcattcccattcttatgccaccctctgcgg

SEQ ID NO: 1199 - DNA, 236 bp, Homo Sapiens
  Pancreas
  sig_peptide 21..80: Von Heijne matrix; score 8.00; seq VCVLVGSFSASLA/GT
atcgaaaaagctctggcacaatggcttttcttccttcctgggtttgtgtactagttggttccttttctgcttccttagcagggacttccaatctctcagagacagagccccctctgtggaaggagagtcctggtcagctcagtgactacagggtggagaacagcatgtacattattaatccctgggtataccttgagagaatggggatgtataaaatcatattgaatcagacgaag

SEQ ID NO: 1200 - DNA, 234 bp, Homo Sapiens
  Lung (cells)
  sig_peptide 157..198: Von Heijne matrix; score 7.70; seq FLVSCVICTGSFA/FN
attaagcagtcacccattcaggaatgagaatattatacacctatatatttattttgtatatattaacaaaattatatatgacattgtagcaggtaggtttgacccagttgcaggttggggctgagatgaaatgtaaaattgtatgtctcattctggatgtttttagtctcgtgcgttatctgcactgggagctttgcctttaataactcaaacgttcctctccccagcagccgg

SEQ ID NO: 1201 - DNA, 465 bp, Homo Sapiens
  Lung (cells)
  sig_peptide 262..393: Von Heijne matrix
  score 7.50
  misc_feature 34..284: seq LMIPLLLLTPITA/TS; blastn; identity 99; region 11..261
  id AA171572
  misc_feature 268..335: est; blastn; identity 91; region 246..313
  id AA171572
  misc_feature 354..390: est; blastn; identity 97; region 334..370
  id AA171572
  misc_feature 394..430: est; blastn; identity 94; region 376..412
  id AA171572
  misc_feature 300..465: est; blastn; identity 90; region 6..171
  id AA218270
  unsure 3: est; position 3 of amino acid sequence; Xaa = Asn,Thr
ttctggagccgaagagagtcggaagaacaagtgatgccatggacaatattaccaggcagaaccaattctacgatacccaagtcatcaaacaagaaaacgagtcaggctacgagaggagaccactggaaatggagcagcagcaggcctatcgtccagaaatgaagacagagatgaagcaaggagcacccaccagcttcctcccgcctgaagcttctcaactcgagccagacaggcagcaattccagagtcgaaagaggccttatgaagaaaaccggggacgggggtactttgagcaccgagaggataggaggggccgctctcctcagcctcctgctgaagaggatgaagatgactttgatgatacccttgttgctattgacacctataactgcgacctccamttcaaggtggcccgagatcggagtagtggctatccgctcacaattgagggctttgcatacctgt

SEQ ID NO: 1202 - DNA, 405 bp, Homo Sapiens
  Lung (cells)
  sig_peptide 58..132: Von Heijne matrix
  score 7.50
  seq XILLAGWCPDTRA/GG
  misc_feature 358: n=a, g, c or t
  unsure -13: Xaa =  * ,Gly
  unsure 54: position 54 of amino acid sequence
  unsure 57: Xaa = Asp,Glu
  position 57 of amino acid sequence
  unsure 76: Xaa = Pro,Thr; position 76 of amino acid sequence; Xaa = Ala,Cys,Gly,Pro,Arg,Ser,Thr
aactttgtgcccagagctccagccacagtgagcatggagctgggcggcccagggtaaatgggcttctttcttccccatggcatctcagacgcckgaatactcctggctggctggtgtccagatactagggcaggaggctgggctgacctctgccttcctgaaaacagaggcccaaagccaccgtcccctcggagtgctctgggcagtgggaggggcctgggttctggccagcctgaggttgaaccaccagccccggagcaggcctgggagtccttgcagggtggcctgggtgamtgctcamcagcmcggccctccccagggttctgggccagagcctccctggccgttggagcggganstgtgggtggaacacttctgaattgggarattgcctcggacctccag

SEQ ID NO: 1203 - DNA, 313 bp, Homo Sapiens
  Colon
  sig_peptide 95..232: Von Heijne matrix; score 7.50; seq VCTLLSSHPASRC/RP
aaccccggcaaggagcgggctctcgtcacttccggcgcccgccgacacgcacttccgttcgtccgcagcgggccctaggcggccgccatgttgaatgtggctccgcccggggagctgctggagtacgagggagccaagaagggctccaaggacctctgcctcttctctgagctcgttcttaggcccctctgccgtctgcacgctcctttccagccacccggcctcccgatgccggcctagcacgttcctcgcgccaggcttttgcatctgcccttcccactgtctttcgtgtgcaaacgccacagatcccgcg

SEQ ID NO: 1204 - DNA, 209 bp, Homo Sapiens
  Lung
  sig_peptide 66..182: Von Heijne matrix
  score 7.40
  unsure -17: seq LFLLSLFCRLYHG/TI; position -17 of amino acid sequence; Xaa = Asp,Tyr
aattaccatgttgcctcaattcttaggaagacttctttttaattgagaggtcttcttgctcctttatgtcagaaggaatggtcacattgctgactttttcttgtttatggactgatgactcatttatgagtkatctaaacgtcttgttccttctttctctcttctgccgtctctatcatgggactattttctttctgctagcacttctg

SEQ ID NO: 1205 - DNA, 227 bp, Homo Sapiens
  Lung
  sig_peptide 69..110: Von Heijne matrix; score 7.30; seq LILGLPLCRPLWI/QR
aagtctgtccgtggatactgtgaacatcaggctactcggccgggctcctgcgctcagggcttcgagaaatgctcattttggggctgcccctctgccggcctctctggattcagagggcagccgctgctccttttgttttgtgggcctggctctgggcccggagcagcacctccctggggaggccgcctttccttccgcggcttcttccgtctcctcctgaccccgag

SEQ ID NO: 1206 - DNA, 162 bp, Homo Sapiens
  Lung
  sig_peptide 16..90: Von Heijne matrix
  score 7.30
  unsure -16: seq HFILLVLPCLIFS/HF; position -16 of amino acid sequence; Xaa = Gly,Val
acatcatcttgctctatgtatatatatttttttgtcttatgtgkkctgtctcacttcattcttcttgtcttaccttgtttaattttttcccattttactttatttttattttacagtgccttattagatatacctctttttttcaagtattccctgatcgag

SEQ ID NO: 1207 - DNA, 318 bp, Homo Sapiens
  Lung
  sig_peptide 112..237: Von Heijne matrix
  score 7.20
  unsure 14: seq ILFSLSFLLVIIT/FP
  position 14 of amino acid sequence
  unsure 18: Xaa = Ala,Glu; position 18 of amino acid sequence; Xaa = Ala,Asp
aatactttctcctctcccctctcccaagcacatctgagttgctgcctgttcttcacacttagctccaaacccatgaaaaattgccaagtataaaagcttctcaagaatgagatggattctagggtgtcttcacctgagaagcaagataaagagaatttcgtgggtgtcaacaataaacggcttggtgtatgtggctggatcctgttttccctctctttcctgttggtgatcattaccttccccatctccatatggatgtgcttgaagatcattaaggmgtatgaacgtgmtgttgtattccgtctgggacgacatggg

SEQ ID NO: 1208 - DNA, 154 bp, Homo Sapiens
  Thyroid
  sig_peptide 101..148: Von Heijne matrix; score 7.00; seq LFCVVLCLSPTSY/CY
tgtttttccttctagaggtccatatgtttacaggcaaattcctacgtacactatatacttccaaccatcccttcctttccctttcagaaatagtagcacaatgtgtatactgttctgtgttgtgttatgtttgtctccaacatcttattgttat

SEQ ID NO: 1209 - DNA, 163 bp, Homo Sapiens
  Lung (cells)
  sig_peptide 80..136: Von Heijne matrix; score 7.00; seq ETLLCLGSSCCQC/RI
ggcagcattcaatccaggaagtgccagcatcacatggtgacttctggtagctgtaacatttagtgactgtctccatgtcatgcacaggggtgacatcgagaccctcttatgcctgggaagttcctgctgtcaatgcagaatattctctttttttttttttttt

SEQ ID NO: 1210 - DNA, 411 bp, Homo Sapiens
  Lung
  sig_peptide 331..387: Von Heijne matrix
  score 7.00
  seq AGLSSCLLPLCWL/ER
  misc_feature 302: n=a, g, c or t
aagcctaggtgtggcgccccgaccggactttcacttctggccagccctttccccacctgggcgcgggassggtgccagtctttaaacaacctctcgatgggtcccacgaagatgtttccagacccttggaatgccaagttcaagtttagctatgtctcgcggagaggccggtggaagaagcaacgagaatgaagcaccccagttctctgctgagcacatgggcatctgcaataaagatttaatttcccagcttctcctgaagctcggtatggccacaacactaaattctgcccgaggagatngagcaaaatagtatgggacttccaagaaatgtttttaaagtcaggggcaggcctttcttcatgccttcttcctctttgctggctggaacgcaaagaccatggcaggagg

SEQ ID NO: 1211 - DNA, 368 bp, Homo Sapiens
  Lung (cells)
  sig_peptide 9..122: Von Heijne matrix; score 7.00; seq LVMVWLGLLPLFS/GP
acctcctaatggcaaatgcaataattaagaagccttgtgcaatgccggcacagcctcacacagggaatctcctgtggccacctcttgtcatggtgtggctcgggctgttgcctcttttctctgggccccacttgcaagccgttcagcatctggcccttgcctacctccctctgaactctgtggttcttgcacataatagtccagccatactgaatgtatggttaactctgagatgccctctcccttacaggatctgcctctggccctttgaacatgcttttccgtctattagaaacacacactcctgcctgtcttcctcctgctgctgccctgcttcagcccctcttttagttgattacctcttcttt

SEQ ID NO: 1212 - DNA, 407 bp, Homo Sapiens
  Lung
  sig_peptide 18..74: Von Heijne matrix
  score 6.90
  unsure 29: seq LQPLLLLLPLLNV/EP; position 29 of amino acid sequence; Xaa = Ile,Arg
aacccaggtccccagcgatgtctccaccaccgctgctgcaacccctgctgctgctgctgcctctgctgaatgtggagccttccggggccacactgatccgcatccctcttcatcgagtccaacctggacgcaggatcctgaacctactgaggggatggakagaaccagcagagctccccaagttgggggccccatcccctggggacaagcccatcttcgtacctctctcgaactacagggatgtgcagtattttggggaaattgggctgggaacgcctccacaaaacttcactgttgcctttgacactggctcctccaatctctgggtcccgtccaggagatgccacttyttcagtgtgccctgctggttacacaccgatttgatcccaaagcctctagctccttcc

SEQ ID NO: 1213 - DNA, 395 bp, Homo Sapiens
  liver
  sig_peptide 264..389: Von Heijne matrix
  score 6.50
  seq ILIGLFSLTGLVA/GN
  misc_feature 106..109: n=a, g, c or t
atatagttttgaaagactacttgaaaaacataatcaaatgatacttggagtttgttccgaaagggtattctttcctctctcttcccacaacagtgtgcgcttcctnnnnatagttgatatacctgtgctttaaaatagcacagctactagtagaggccattttataccaaaatcatttcccttcatgttctgtggtacatcagtttggcagtagaggttacagagtttgaaatcaaaaggagcattggttccttcagggaaaaatgataccaatctaccaaaataaaagccaaacagactctcattgttctttatcccacaaggggcttgcctttttgaaggtgtggttaattttgataggactcttctctctaacagggttagtggctgggaat

SEQ ID NO: 1214 - DNA, 205 bp, Homo Sapiens
  Lung (cells)
  sig_peptide 86..145: Von Heijne matrix; score 6.50; seq LLSGSTCPGPCSC/GS
aggtgtctgccctgcttatgggattgtgcagttgacctgagcagaggatggagctcactcctctttaaaccaagggccctgagccatggctcttcccgggatccaccttctctcaggctcaacttgccctggaccctgttcctgtggatccttgaggagccctcctgggcctgtgactgataaacccctccccctgccgccccag

SEQ ID NO: 1215 - DNA, 245 bp, Homo Sapiens
  Colon
  sig_peptide 60..182: Von Heijne matrix
  score 6.40
  unsure -20: seq IALIPLFSTXAFA/IX
  position -20 of amino acid sequence
  unsure -19: Xaa = Asn,Ser
  position -19 of amino acid sequence
  unsure -4: Xaa =  * ,Gln
  position -4 of amino acid sequence
  unsure 2,14: Xaa = Ser,Thr
  position 2, 14 of amino acid sequence
  unsure 17: Xaa = Ala,Ser,Thr; position 17 of amino acid sequence; Xaa = Gly,Arg
aattctaggctggtcactactccgagcctgtdwcgtttgcggcagccaggccgtcgacgatgcccagtgaaactctctgggaaattgcaaaagctgaagtggaaaaaaggggaattaatggaartyaaggtgatggagctgaaattgcattaattccccttttttccactwcagcttttgcaattdcccagatagtktcactgggcatcgtcgacggcagtdctccaccargatccaggaccccg

SEQ ID NO: 1216 - DNA, 234 bp, Homo Sapiens
  Lung (cells)
  sig_peptide 61..171: Von Heijne matrix; score 6.40; seq LCMSLTFLALSTL/RF
atgctacccaggacaatgctaggggcacatgggcacagcatgaaataactgcatctcagaatggaatggttacgcccctcccaaatctccttctatccgggttacagcaaggaaaggctccgtttggtgctactatgcatgtccctaacctttctagcactttctactctccgctttttaacacagagagtgcagatgcaggctgggtgccctctgcggagtccacgcctctgg

SEQ ID NO: 1217 - DNA, 163 bp, Homo Sapiens
  Liver
  sig_peptide 41..94: Von Heijne matrix
  score 6.30
  seq HLTLLALLSVNTG/KE
  misc_feature 136: n=a, g, c or t
aatcatttcctcctcagattaccaagcaagaacagctaaaatgaaagccatcattcatcttactcttcttgctctcctttctgtaaacacaggtaaggaatatttttacattttaattcttccaatcatgtatgtngtctttgaggtagaatcagccggccag

SEQ ID NO: 1218 - DNA, 155 bp, Homo Sapiens
  Liver
  sig_peptide 21..107: Von Heijne matrix; score 6.30; seq SLPLALTLSLSTS/LH
acactactattttaaggaaaatggatgtgtcagccagcaagccagtggcagagtcttggtctccaggctccctgcctcttgcactgactctttctctttcaacctccctgcatgacagctggaaagagcccatccctaatcttcaccaaccggcg

SEQ ID NO: 1219 - DNA, 149 bp, Homo Sapiens
  Liver
  sig_peptide 33..116: Von Heijne matrix
  score 6.20
  unsure -4: seq IQTALLGLPXAWA/SS; position -4 of amino acid sequence; Xaa = Lys,Arg
acctggttgtaacccagccttcttccttacagatgggggtgagggttggggtatcccttagagcctggtgtgtcttcatacaaacagctttgctggggctgcctaragcctgggccagcagtggggtagtatcaagtacagggccgggg

SEQ ID NO: 1220 - DNA, 106 bp, Homo Sapiens
  Lung (cells)
  sig_peptide 20..85: Von Heijne matrix; score 6.10; seq FFLLLCIPFLTLL/LY
ccatgaaaccatcaagattatgattatatccatcatccctagaagtttcttcctactgctttgtattccctttcttaccctcctcttgtatacatacccccccagg

SEQ ID NO: 1221 - DNA, 433 bp, Homo Sapiens
  Thyroid
  sig_peptide 272..358: Von Heijne matrix
  score 5.90
  seq WTLVLMSPEWALL/QY
  misc_feature 65,263..264: n=a, g, c or t
  unsure 12: position 12 of amino acid sequence; Xaa =  * ,Cys,Pro,Arg,Ser
accctgccctcttcttgtgttgtgtttgtcacagccttgcccctcttgctcgccttgaaaatggnmaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgnnaacacccatgactatgcaaaggtcaaggagttcatcgtggacatcttgcaattcttggacattggtcctgatgtcacccgagtgggccytgctccaatatggcagcactgtcaagaatgagttctccysmaagaccttcaagaggaagtccgaggtggagcgtgctgtc

SEQ ID NO: 1222 - DNA, 328 bp, Homo Sapiens
  Lung (cells)
  sig_peptide 239..307: Von Heijne matrix; score 5.80; seq LCSLMASISPTLT/AV
cctttctggctgtggctgactcctcggacactcttccttctcatcttccttcggcttctagaccacagtcttcttctttgctttttgtccttccaggcagattggcaatgaaagttgtgccgctcgatgtccctgaactgccccaggcctcctcctcccctcaaggcactccacggctagccacctggcagcctgggctgctcactagaaggctactgccctctaccccactgctttcatgatcaccctccctcagacctccagcctgctctgtagcctcatggcctccatctcccccaccctcactgctgtgattctgtggcccccg

SEQ ID NO: 1223 - DNA, 334 bp, Homo Sapiens
  Liver
  sig_peptide 101..289: Von Heijne matrix
  score 5.70
  unsure 10: seq PLVTHGLLLQAWS/RR; position 10 of amino acid sequence; Xaa = Gly,Ser
aagttaatcagtcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcargcgcatttctccgagca

SEQ ID NO: 1224 - DNA, 392 bp, Homo Sapiens
  Lung (cells)
  sig_peptide 270..359: Von Heijne matrix; score 5.70; seq LGVGCHFFHLALG/RF
caactctaaaaatctttacacagcctatggagagaaacctaagcaagtscccaaatcctcaagtgttccaggagaatgaaaagaattataaaggctaaagaattattagaatcagtgcagtgaacatgtagaccaaagcattcctgcatgccaggaaaatggtgcatttgaatgtttttgcttctcatgagaaaggcaatttaagttgcaaggcaaaggcaaacttttgaagatggccacgtggactctggatccttctctctttgttcatgatttgttctcccttcagtggttttgctccttgccaagcattaggtacccttggggtgggatgccactttttccacttagccttgggcaggtttcttctctccttatccaataatatttac

SEQ ID NO: 1225 - DNA, 511 bp, Homo Sapiens
  Pancreas
  sig_peptide 62..355: Von Heijne matrix
  score 5.60
  seq LLLLRGADRVLQA/HI
  misc_feature 94: n=a, g, c or t
  unsure -89: position -89 of amino acid sequence
  unsure 20: Xaa = Leu,Arg
  position 20 of amino acid sequence
  unsure 33: Xaa = Ala,Glu,Val; position 33 of amino acid sequence; Xaa = Lys,Asn
aaggcagtcccggcgcggggcaaccacagcgctcaggaggccctgagtccggcacctggccatgtgcaaccctgaggaggcagctctgcksggnctggaggaggtcttctcagccaccctcgcccatgtcaacagccttgtcctccagcccctgctcccagccgccccagatccctcggatccctggggcagagagtgcctgcggctcttgcaacagctgcacaagagctcccagcaactctgggaggtgacggaggaaagcctgcactcactgcaggagaggctgcgttacccggactccaccggtctggagtccctgctgctgctgcgaggtgctgaccgtgtactgcaggcccacatagagtacattgagtcctacacaagctgcatggtggtgcaggccttccagaarghagcyaagaggagaagcgagttctggcggggccagcggaakgcgctgcggcagctgctttcaggtgtkagctcagagggctcggtgggcgcatcgctg

SEQ ID NO: 1226 - DNA, 340 bp, Homo Sapiens
  Thyroid
  sig_peptide 131..265: Von Heijne matrix
  score 5.60
  seq LLVIHWVMCPSLS/QS
  misc_feature 35..36: n=a, g, c or t
cttttctggtccagagcccccacaggaaggagavnnbsaaaagattactgttgactgcacagttccaggggccaaggcagaagaaatcctggagaaaggtccaaagacagcgatctcctggacatgaaagatggacaagctgatacccagcttgagctctcaagagaacagaaaggcgtctcacactctccacaaagctagaaacaaacaacactgtggaggatttttactggtcatacattgggtcatgtgcccttccctgagccaatctgcagtcagaaggatgaagtactctaattggccagttttgggtcacgtgcctgttcctggctgtcattgc

SEQ ID NO: 1227 - DNA, 231 bp, Homo Sapiens
  Lung (cells)
  sig_peptide 127..177: Von Heijne matrix
  score 5.50
  unsure -15: seq LPVVLASPPVGHG/LP; position -15 of amino acid sequence; Xaa = His,Gln
taattgggcagccagggtctcctggagcatggcggtgacattcagagccccacagcaactccgggcatcccacctctgcctaggtgggatacatcttgagcctacggcagtccctctgtcggtctcatgagccakcttcttcctgtggttcttgcctcacctccagtaggccatgggcttccctccccagtacctctgttacaggacccctgccccctccctgctgtcggg

SEQ ID NO: 1228 - DNA, 128 bp, Homo Sapiens
  Lung (cells)
  sig_peptide 54..92: Von Heijne matrix; score 5.50; seq MVLLTMIARVADG/LP
agacggcgccaagggccttccgggccagtgttggatccctgtagtttgtgaagatggtgttgctaacaatgatcgcccgagtggcggacgggctcccgctggccgcctcgatgcaggaggacgaagag

SEQ ID NO: 1229 - DNA, 208 bp, Homo Sapiens
  Large intestine
  sig_peptide 32..190: Von Heijne matrix
  score 5.50
  misc_feature complement(82..206): seq LLELLFVPLLCFL/SK; blastn; identity 100; region 159..283; id AA255968; est
cactaaagctgccctcctcctactgttccctatgtttcatattgctttttctgaggctctacctgtagacatcttcaagacccaacccaactgtcatgaagccttctccatgaaggctatccatataaccagaataagaagtggtctttgcctccttgaacttttgtttgtaccacttttatgtttcttatccaaaaaatggccttgg

SEQ ID NO: 1230 - DNA, 260 bp, Homo Sapiens
  Pancreas
  sig_peptide 147..221: Von Heijne matrix
  score 5.40
  unsure 12: seq SLLTETVLPLAFP/GP; position 12 of amino acid sequence; Xaa = Gly,Val
attattttaaatattatcatggacagttgttattggaaatgacagttcaccattgcaaatcaatgcagtggctacaagtcccccgtgtcacacaaaaatagacggggtagctctgacagcatgcatcctkatgccctgttctattaatgatgcactgcaccccatcagggtctgcagctgtatcattactcacagagacggttctgcctttggctttccctggtcctccatggctaggaacatcatttaacagggktttg

SEQ ID NO: 1231 - DNA, 316 bp, Homo Sapiens
  Lung
  sig_peptide 95..178: Von Heijne matrix; score 5.30; seq RISCAFSLASSTA/RQ
aggaagtggccagtcggcaggtctgaggcggcgctgtgtgtgtgaagcgtacctagggcgggaggcgacatggagacaggggcggccaagctgtatgaccaggcccttttgggcatcctgcagcacgtgggcaacgtccaggatttcctgcgcgttctctttggcttcctctaccgcaagacagacttctatcgcttgctgcgccacccatcggaccgcatgggcttcccgcccggggccgcgcaggccttggtgctgcaggtattcaaaacctttgaccacatggcccgtcaggatgatgagaagagaaggccta

SEQ ID NO: 1232 - DNA, 452 bp, Homo Sapiens
  Lung (cells)
  sig_peptide 192..269: Von Heijne matrix
  score 5.20
  seq SCCLIQWPELSFS/NT
  misc_feature 13: n=a, g, c or t
  unsure 15: position 15 of amino acid sequence
  unsure 16: Xaa = Arg,Thr; position 16 of amino acid sequence; Xaa = Cys,Ser
actaaacagmcdnhwacattcaggtgggkaccttcctccagaagttactcctacatcagaaaagatgacccccttcttcctgatgctcagagccatcaatactcctttgtctctcacctagcacccaattcatctggaaatcctattggcaccaccttaaatatgtaaacagaacctgatcaagagcccccatggtcacccacctaattaggggggtggtgttgcagggctcctgctgtctcatacagtggccagagttaagcttttcaaacacaaatggtgtttgtcccatctatcccccaccttctatcasgtscctgagaatgtcatcctgctctcctctgactgtatctctctgcccttgctatgtagaatgtgcatccaccccagggcctctctgcttgctcttttcttggccaagaaacacctctcccaacatgccctctggctac

SEQ ID NO: 1233 - DNA, 254 bp, Homo Sapiens
  Lung (cells)
  sig_peptide 60..116: Von Heijne matrix; score 5.20; seq LLVAFRVFLGLFS/LP
actgtagccaaattaaaatctgagtctggcgtttccvtttgggaaggtgctcagtagctatgtacatgtggtccaaactcttggtggcattcagggtctttcttggccttttcagcctcccctctaaccacaacacatactgtcccttccagccttggggaattccttgcagcctcagaataggaggcctcctccatctgcagtgccctttgcccccctctctacatcctctkcctagtctactcaccagccgg

SEQ ID NO: 1234 - DNA, 212 bp, Homo Sapiens
  Lung (cells)
  sig_peptide 78..146: Von Heijne matrix; score 5.20; seq FLFGLYSFRAVDS/SR
tagaaaagcaagaactgggactagtttcaggattttctgaatctagagaataaaataaacagttgctagatgagctaatgtcatctagaaactgtttctttccatctttcctctttgggctttattctttcagggctgttgacagttctaggattaagctcagtttattaaccaaggaggaagaaaccccttctgcctactacagatccctg

SEQ ID NO: 1235 - DNA, 140 bp, Homo Sapiens
  Lung (cells)
  sig_peptide 33..86: Von Heijne matrix; score 5.10; seq CLYLHVYVLTCSG/CN
atttcagaaaggaggagttgatgatcttctagatgtatatgaacacctgtctatatctgcatgtatatgttttgacctgcagtggttgcaatgttgatatgtgttcaagattattcctgtctacaaaactgaaggcccgg

SEQ ID NO: 1236 - DNA, 221 bp, Homo Sapiens
  Lung (cells)
  sig_peptide 54..200: Von Heijne matrix; score 5.10; seq VALSASLPQCSLG/LL
actccacccccagccctgcccctccacacctcgccccaagagcagccagagagatgtcctgccgacaacccaccccaacacagtgttccctactcccaaacgacaaccgtgtctctacgaggggaggggacagtgctgggcgccaccgccaagtccctcaggtggctctgagtgcaagtctgccccaatgctcccttggactcctcataaacccccgcctg

SEQ ID NO: 1237 - DNA, 158 bp, Homo Sapiens
  Thyroid
  sig_peptide 84..143: Von Heijne matrix; score 5.10; seq PTAGVVVLQGSRA/SV
gaaatgtttccttttgtgttaaaaaaggtgaagttttgggattactaggacacaatggagctggtaaaagtacttcvattaaaatgataactgggtgcacaaagccaactgcaggagtggtggtgttacaaggcagcagagcatcagtaaggcaacgg

SEQ ID NO: 1238 - DNA, 70 bp, Homo Sapiens
  Lung (cells)
  sig_peptide 20..61: Von Heijne matrix; score 5.00; seq GLDLILSFSSSSP/GP
tatctagtgtgtcacgccaatgggcttggacttaatcctttctttctcctcctcttcccccggtcctggg

SEQ ID NO: 1239 - DNA, 218 bp, Homo Sapiens
  Colon
  sig_peptide 12..197: Von Heijne matrix; score 4.90; seq LDRLCALTSLCSP/GP
gaattccagggatgcgggaggacaatgagcatgaacgaaacgtgccgagtggagttgagaacgtaaaggaagaagggggagatgaggacctctcctggggagatgagggctgccaagtcctaagacacaggctcagggtctgcaggaaggtcggcttgttggatcgtctctgtgcgctgacttctctttgctccccagggcctctacccgctaccctg

SEQ ID NO: 1240 - DNA, 96 bp, Homo Sapiens
  Colon
  sig_peptide 10..63: Von Heijne matrix
  score 4.90
  seq GAVVSSWAXCSLG/XP
  misc_feature 51: n=a, g, c or t
  unsure -5: position -5 of amino acid sequence
  unsure 1: Xaa = His,Gln; position 1 of amino acid sequence; Xaa = Gly,Leu,Arg,Val
agccttcgcatggggaaacgggctggtgcagtggtgtcatcttgggctcantgcagcctcggasktcctgggatccagcgatcctcccgcttaacg

SEQ ID NO: 1241 - DNA, 302 bp, Homo Sapiens
  Lung (cells)
  sig_peptide 57..119: Von Heijne matrix; score 4.90; seq WLLSDILGQGATA/NV
agtggcgcggcggagacccggctggtataacaagaggattgcctgatccagccaagatgcagagcacttctaatcatctgtggcttttatctgatattttaggccaaggagctactgcaaacgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacggcgg

SEQ ID NO: 1242 - DNA, 309 bp, Homo Sapiens
  liver
  sig_peptide 109..255: Von Heijne matrix; score 4.90; seq LLCLSGLELEPSA/SD
aaagtcacwwaaacaagttagtaagttatgaaattagttacatgcatggaatattcatgcttgaatgarscttaaaagtttatctaacccaaacctcagattttacagatgaagaagctgaggcccagccaggaacagctgaactgtccggagccacaactggcagatggcagagctgggattagattgctagtaacctggctccaacctgcacctctgctctgcctctctgggctggaactagaacccagtgcttctgactttggatttagttctcataccactctcctgtgctgccttgttgaaaat

SEQ ID NO: 1243 - DNA, 372 bp, Homo Sapiens
  Large intestine
  sig_peptide 151..207: Von Heijne matrix; score 4.90; seq RLLFWSIFSSVTC/RK
agattggtcgaacaaaccagtattatgcaaacctcatccaaaccctctgatttccttaacttggctaagaaaaagaggaagttctccgagtgactcaccactgtggttctactatgccttctgaccccgtcttggacttcaactgggagaatgtggagccatttgaacaggctcctcttctggagcatattttcttctgtcacttgtagaaaagctgtattggattgtgaggcaatgaaaacaaatgaattcccttctccatgtttggactcaaagactaaggtggttatgaagggtcaaaatgtatctatgttttgttcccataagaacaaatcactgcagatcacctattcattgtttcgacgtaagaca

SEQ ID NO: 1244 - DNA, 384 bp, Homo Sapiens
  Lung (cells)
  sig_peptide 136..291: Von Heijne matrix; score 4.80; seq SLLLAQATSNVVC/SL
aatgggcagggaccgaggctgaaagagacaggagtcctccagccgaggagaagctgatgcagctgggcttgtcccagagggagaggggttttcttctccaacggggagcggtggaggcagctgaggaagtttaccatgcttgctctgcgggacctgggcatggggaagcgagaaggcgaggagctgatccaggcggaggcccggtgtctggtggagacattccaggggacagaaggacgcccattcgatccctccctgctgctggcccaggccacctccaacgtagtctgctccctcctctttggcctccgcttctcctatgaggataaggagttccaggccgtggtccgggcagctggtggtacctgctgggagtcagctccc

SEQ ID NO: 1245 - DNA, 217 bp, Homo Sapiens
  Liver
  sig_peptide 17..73: Von Heijne matrix; score 4.80; seq STSLCGCLRQLRC/SM
acgcagctggtcagcaatgctcagtgtgggagccagcaccagtttgtgtgggtgcctgcgccaactgcggtgcagcatgctggatctgcagtggagctttctcgaggatggggagccatgcagagcccgcctctcacccctgcctccacttgctcacttggctggaatctggatagtcctgccaagggctagtttttcagtcatggattaccatgcg

SEQ ID NO: 1246 - DNA, 152 bp, Homo Sapiens
  Lung
  sig_peptide 84..140: Von Heijne matrix; score 4.80; seq VLLSQFLYPLAYP/HP
atttcctttgggtgctccaactcttgtaacttcacaggcaacaacgttatctacgttccagcccgctaataaacttaataagaatgttccaacaaatgtacgttcttctttcccagtttctctacccyttagcttatcctcaccctattggg

SEQ ID NO: 1247 - DNA, 296 bp, Homo Sapiens
  Lung (cells)
  sig_peptide 225..272: Von Heijne matrix
  score 4.80
  unsure -10: seq HFCXIGFLSYTTS/LV; position -10 of amino acid sequence; Xaa = Leu,Val
attctaaatgttctcagatgactttcatttcactcacatcctgagattatgctgtggcattaatcaattactactttttataattttttttcagtagatctactagaaagaaagaaaagatctactagaagtcaagaaaatgaatgctcagttaagtgaggggagaaggaaagtatttattgttattactattttttataacgtcagagacctaatagtgaagaatgactagtcatttttgtktgattggttttttatcttatacaacctccttggtctactggaatgcaggccgg

SEQ ID NO: 1248 - DNA, 255 bp, Homo Sapiens
  Thyroid
  sig_peptide 115..189: Von Heijne matrix; score 4.80; seq NVLLSGSLLRSLC/LK
tctctgacttcctctgcttttctctgaatcttctactctgctgcagccacattggcttccttcttcaagcactggaagctcgctcctgtttcagggcctttgttccaaacatacatgatttgctctctcactcccttcaggtctttgactaatgtccttctcagtggaagccttctccgatcactttgtttgaaatataaaccactcacctccatcttccttgtctcaatgtgtcctataccctttccctgccat

SEQ ID NO: 1249 - DNA, 194 bp, Homo Sapiens
  Colon
  sig_peptide 93..173: Von Heijne matrix; score 4.70; seq PALTLTFLPPSPT/LP
acttctagggaagggctggggaggagggggtggtgacacggtggagacaccggctaggccagggggcctgcccttgggacaggtccagacccatggagccccccgggaggagcagcagccttcccttttcccctcccgcactcactctcaccttcttgcccccatcgcccaccctgccacttccctcccctggg

SEQ ID NO: 1250 - DNA, 282 bp, Homo Sapiens
  Colon
  sig_peptide 94..258: Von Heijne matrix; score 4.70; seq IGILCSLLGTVLL/WV
aagggcggctgcctagcacccggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggacatggg

SEQ ID NO: 1251 - DNA, 179 bp, Homo Sapiens
  Lung (cells)
  sig_peptide 84..158: Von Heijne matrix; score 4.70; seq LGMVCIFSLRLQA/VF
attctctttttgttttgtttctttgcttttcacatgttaccagctacataatttcttgacagaaaaaaataaatataaagtctatgtactccaggcatactgtaaaactaaaacaaggtttgggtatggtttgtattttcagtttaaggctgcaagcagtatttacaacagagggaagg

SEQ ID NO: 1252 - DNA, 212 bp, Homo Sapiens
  Lung (cells)
  sig_peptide 48..119: Von Heijne matrix
  score 4.60
  unsure 21: seq SLLLYSLPLNIIG/LN; position 21 of amino acid sequence; Xaa = His,Pro,Arg
atagcaatagaaagagccagaatatgtgctttagtttgttttaatgaatgtatccttcacttttagttgactatttccctagtcttttgctatacagtttacccttgaacatcataggtttgaactgtgcatatccacttataaataattttttaaaaaataatagttacacttgtgtgcvtgtccctcttgctttcccttccatgccgtcg

SEQ ID NO: 1253 - DNA, 345 bp, Homo Sapiens
  Lung (cells)
  sig_peptide 109..339: Von Heijne matrix
  score 4.50
  unsure -31: seq LPTQFLFLLGVLG/IF; position -31 of amino acid sequence; Xaa = Leu,Arg
attagctstccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgckgactctcccgatcctcgtctgcaaggtgcaggactccaacaggcgaaaaatgctgcctactcagtttctcttcctcctgggtgtgttgggcatcttt

SEQ ID NO: 1254 - DNA, 266 bp, Homo Sapiens
  Large intestine
  sig_peptide 63..113: Von Heijne matrix; score 4.50; seq HLDHLFFSGVVLG/QG
aactggcatcactgctaatgaaaaatgctggacttgggatgatattatgmagttagaaattgatgagattgcagcacctcgatcatttatttttctctggtgtggttctggggcaggggttggaccttggaagagtgtgtttacgaaaatggggttacagaagatgtgaagatatttgttggattaaaaccaataaaaacaatcctgggaagactaagactttagatccaaaggctgtctttcagagaacaaaggctgggctcggg

SEQ ID NO: 1255 - DNA, 311 bp, Homo Sapiens
  Pancreas
  sig_peptide 78..170: Von Heijne matrix; score 4.50; seq VAFGLYNPSLCHA/CT
actgacgtgtctttgctcctgataccatttttccccacaccacaccactgtcctctgtgcctgtggaaaccactcaaatgcctctccccaagccttctttcagtaacaaccatctcatccggttgattactgtagctttcggcctgtataacccctccttatgtcatgcctgtaccagatgttccactgcatctgtatcccaccagattgcacattccccgaagcagaaaccttctaatctgggggccattcagggcctagcacagtgcctagtagagcatatgtgttgtagaataaatatagacacatgg

SEQ ID NO: 1256 - DNA, 458 bp, Homo Sapiens
  Pancreas
  sig_peptide 177..401: Von Heijne matrix
  score 4.40
  seq QXRLCVSPSGLRC/EP
  misc_feature 361,366: n=a, g, c or t
  unsure -14: position -14 of amino acid sequence
  unsure -12: Xaa = Lys,Met,Arg,Thr; position -12 of amino acid sequence; Xaa = Phe,Ile,Leu,Val
aataataggcactgaagacatgttaatggaaggtggatttgtgattcagaacctctagactacctgggcgagtcttttaaaatgtttctgcatatgaagtgtgtaaaatagattgcttgatccaaaacagaaaaacagtgataactgttttgctgagttcccagacccttcccaagatggaaccaataacattcacagcaaggaaacatctgcttcctaacgaggtctcggtggattttggcctgcagctggtgggctccctgcctgtgcattccctgaccaccatgcccatgctgccctgggttgtggctgaggtgcgaagactcagcaggcagtccaccagaaaggaacctgtaaccangcaantccggctttgcgtttcaccctctggactgagatgtgaacctgagccagggagaagtcaacagtgggatcccctgatctattccagcatcttt

SEQ ID NO: 1257 - DNA, 177 bp, Homo Sapiens
  Colon
  sig_peptide 58..132: Von Heijne matrix; score 4.40; seq FFCWEVGVSGSSA/GP
aaaaggtacccgcgagagacagccagcagttctgtggagcagcggtggccggctaggatgggctgtctctggggtctggctctgccccttttcttcttctgctgggaggttggggtctctgggagctctgcaggccccagcacccgcagagcagacactgcgatgacaacggacgac

SEQ ID NO: 1258 - DNA, 175 bp, Homo Sapiens
  Lung (cells)
  sig_peptide 62..121: Von Heijne matrix; score 4.30; seq YLCHISLLDVTQQ/FP
acaagaagatcagacacgtacactgaaaaagaacccacgttacagagcagtgttgttgaggatgaaacaaaacacagatccatatctgtgtcatataagcttgctcgatgtaactcaacaatttccaaatccacttcctggcagaaccatctttcctggttcctcaacccccagg

SEQ ID NO: 1259 - DNA, 186 bp, Homo Sapiens
  liver
  sig_peptide 34..138: Von Heijne matrix; score 4.30; seq LISLLSSPNTPSA/SI
ataaatttgtgtaaaatacaaaatatgtaaaatatggtgacatattttaacttcaccttcaagccattttgcattctggcctcaattattgttcccactcttatctctttactttcatctccaaatactccaagtgcatctatttactattctccaaagtgtctttgtccattagccacccccagg

SEQ ID NO: 1260 - DNA, 197 bp, Homo Sapiens
  Colon
  sig_peptide 114..182: Von Heijne matrix
  score 4.30
  unsure -12: seq QXILLGTTSVVTA/AL; position -12 of amino acid sequence; Xaa = Cys,Phe
atccggtcaggttaggccgggggggtgcggtcctggtcggaaggaggtggasagtcgggggtcaccaggcctatccttggcgccacagtcggccaccggggctcgccgccgtcatggagagcggagggcggccctcgctgtgccagtkcatcctcctgggcaccacctctgtggtcaccgccgccctgtactccgtg

SEQ ID NO: 1261 - DNA, 377 bp, Homo Sapiens
  Pancreas
  sig_peptide 105..233: Von Heijne matrix
  score 4.20
  unsure -21: seq HMMAAAVADGTRA/AT; position -21 of amino acid sequence; Xaa = Glu,Gln
aagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtcksaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacgatg

SEQ ID NO: 1262 - DNA, 370 bp, Homo Sapiens
  Lung (cells)
  sig_peptide 308..358: Von Heijne matrix
  score 4.20
  unsure -5: seq SVIWFGSVXPCIS/XV
  position -5 of amino acid sequence
  unsure 1: Xaa = Phe,Ile,Asn,Ser,Thr,Tyr; position 1 of amino acid sequence; Xaa = His,Gln
tctttacaattagctagttgcgattggctaagttgtwagggcctaaatacttactaagctgtctggagcctaacccagcagaagggttagatatttcttttagcttaggggcacagtgagaaaaattgctgagactaagggccccataaacataggaaattggagaacttctagctgaaactgatcatggttcctccttgatcagtcttggggcaggaactgggactggggcctgcctcacctgaagcccatgaagagtgtatacctgaataaactcttataaagaaaggaggggaatgcattaggaatgccactaaactcagtgatatggtttggatctgtgwhcccatgcatatctcakgttgaattg

SEQ ID NO: 1263 - DNA, 363 bp, Homo Sapiens
  Lung
  sig_peptide 253..342: Von Heijne matrix; score 4.20; seq FLDFANLADLTLA/ES
aagaggaaggagctgtgggaagctcgcagcaggtatcggagcttaagccagtggatttgggggccctgggctccctagccggctgcggtgtgagaatggagtgggcakgaaagcagcgggactttcaggtaagggcagctccgggctgggatcatttggcctcctttcctggcccttctctccggctgttttctgggagtcargmgagtgtctgtagtctctgctcggggtttggggctcaggaatgatgtcatgctccaacagttggattctattagcttaaggaggagggaaacagccaattttcttgactttgcaaatctagctgatctcactcttgctgaatctgaggtgtttagactt

SEQ ID NO: 1264 - DNA, 435 bp, Homo Sapiens
  Lung (cells)
  sig_peptide 268..411: Von Heijne matrix
  score 4.10
  misc_feature 1..90: seq FTTLSNLSLPSQT/KD; blastn; identity 90; region 163..252
  id AA236618
  unsure -36: est
  position -36 of amino acid sequence
  unsure -35: Xaa = Leu,Arg; position -35 of amino acid sequence; Xaa = His,Asn
cgtccatcagatcctgaccctaaggctggtgactttgtagctatgaaagcaggaaatgaaggcatagtacaatttcctaaagatgaaaaacaatatcttgttcccctctgtttttgttattacaagaaataatctatctactactcgtcagcacctgtctttgtgtctgaagccaagaataaattcatcaacttggtagccactgctgcaactgaagccaaccgcagtcaatgttggctatatgttgagttgccggaggcgcctggaatgtgctaccttgcagaattgtccctgacaacatttckvmatggctatattgttaccagtagggccacaacaacaacaacacttgcaatccaacctgggcttcctttcaccacactaagcaatctatctttgccaagtcagacaaaagatgaactccaccctccctgg

SEQ ID NO: 1265 - DNA, 127 bp, Homo Sapiens
  Pancreas
  sig_peptide 56..106: Von Heijne matrix; score 4.10; seq LSSLILLPIWINM/AQ
atgccccctcagccctgtggctgggggcagagctcagactgtcttctgaagattgatgtctatttccttgagctctttaattttgttgccaatttggataaacatggcacaaatccagcggggaggt

SEQ ID NO: 1266 - DNA, 462 bp, Homo Sapiens
  Lung
  sig_peptide 88..345: Von Heijne matrix; score 4.00; seq LLFALSWKSDAPA/TS
acgcttcctgtaccaccctgctcaagtagcggacacggaacagggaactatcagcccgtcggcctccgggccctgcattctctagccatggaccgggaccttttgcggcagtcgctaaattgccacgggtcgtctttgctctctctacttcggagcgaacagcaggacaatccacacttccgtagcctcctggggtcggccgccgagccagcccggggcccgccgccccagcacccgttgcagggcagaaaagagaagagagttgacaacatcgagatacagaaattcatctccaaaaaagcggatctgctttttgcactttcctggaaatcagatgcacctgcaacttctgaaattaatgaagacagtgaagatcattatgcaatcatgccacctttagagcaattcatggagatacctagtatggatcggagagagctgtttttccgagatattgagcgt

SEQ ID NO: 1267 - DNA, 320 bp, Homo Sapiens
  Large intestine
  sig_peptide 246..296: Von Heijne matrix
  score 4.00
  unsure -9: seq TLVTXXNASCSFA/SV
  position -9 of amino acid sequence
  unsure -8: Xaa = Cys,Ser; position -8 of amino acid sequence; Xaa = Leu,Val
ggtttcttggttttcttgttttcccatatgtttgtatccctaaacaaaagattgcttagttctgcatgtttttcaactttatgtaaatgaaatcacactgcatttattcttctctgactttatttagctgaacattatgcatctgatccccatccatattgtcatgggtaactagcatttattgtcttcactgctgaacaagtagaacctattcagttcactgcccacttgtcttcccagattccatggttctggccacactagtgacttstktaaatgcatcctgctcttttgcgtctgtgcatcttgcccagggtggg

SEQ ID NO: 1268 - DNA, 283 bp, Homo Sapiens
  Lung (cells)
  sig_peptide 167..226: Von Heijne matrix; score 4.00; seq IILKVLLNQTCQT/VQ
aaaaggtcttcgaatttcaactcgtcaagtacatcacactccagtttgaaaagtccaagccacatggaaaaatacccgcaaaaagagaaaaccaaagaagatctggattcacgaagcaacctacacttgccagaaactaaattttctgaattgtcaaaactgaagaatgatgatatggaaaaggctaatcatattgaaagtgttattaaatcaaacttgccaaactgtgcaaacagtgacaccgacttcatgggtcttttcaaatcaagccggtatgacccgg

SEQ ID NO: 1269 - DNA, 322 bp, Homo Sapiens
  liver
  sig_peptide 23..205: Von Heijne matrix; score 4.00; seq AALVKCLPVLCLA/GF
gctctggggctatcaggccagcatggacgctggcaaagcggggcagaccctgaagactcactgctcagcccagcgcccagatgtctgcaggtggctgagccccttcatcctctcctgctgcgtgtacttctgcctctggattcccgaggaccagctgtcctggttcgctgccctggtcaagtgcctgcccgtcctctgcctggctgggttcctgtgggtcatgtccccaagcgggggctacacccagctcctccagggagcccttgtgtgctcggctgtgggggacgcttgcctcatctggccggcagccttcgtcccaggg

SEQ ID NO: 1270 - DNA, 316 bp, Homo Sapiens
  Lung (cells)
  sig_peptide 107..190: Von Heijne matrix; score 4.00; seq PLLGVLFFQGVYI/VF
atttaagttgtctctcggcctcctgctctgacgtcacttccggtgttacctgtgtcgttaccgggagctgtaaacaaggtgtgcaagcatctgaagagctgccgggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaagcttactatagactggacacag

SEQ ID NO: 1271 - DNA, 153 bp, Homo Sapiens
  Colon
  sig_peptide 1..96: Von Heijne matrix; score 4.00; seq LIYWYVLLILSFP/FI
atgctcggaacacatatctacgtgtccttatggattattcttttctcttccccacatcttatctattggtatgttctgttgattttgtcttttccatttatcatcaaattttctatgaacaccttgtccagaccaccacctgacaccccccag

SEQ ID NO: 1272 - DNA, 131 bp, Homo Sapiens
  Pancreas
  sig_peptide 69..125: Von Heijne matrix; score 3.90; seq FLNLHGFLGHLLS/GE
acatcaggataaaaaatctgtaatactaaaaatgttaaataatttcagttgccaaattttcagttgaaatgtcaatatataatttatttcttaatttgcatggctttttaggtcatttattatctggggag

SEQ ID NO: 1273 - DNA, 429 bp, Homo Sapiens
  Lung (cells)
  sig_peptide 343..417: Von Heijne matrix
  score 3.90
  unsure -5: seq PACVCMCTXSCYS/CQ; position -5 of amino acid sequence; Xaa = Leu,Arg
ccttgcttccstaacagactttagccctagggaagtcagacctgatcagtgcagggcgttcttgccgataagttggggatggttggacctgagcacctcttggtcagctggcctctcccagggctccaggctacccacacctgcttgcagtgcgacctcggttgcccaggtggggtcccttatgggggtgtacatcatagctcctgtgctggtgaactgcagttgataaatcccatagtcgtgcaacagcccacctgcaccttcccaaaactgcggcctctctgagacactttgcctgcatgcattcacctatggccacccccgacgttgctttgccagcatatgtgcatgcaagtggaccttgccttctcttttccaccagcatgcgtgtgcatgtgcaccckgtcatgctacagctgccagtgtgag

SEQ ID NO: 1274 - DNA, 265 bp, Homo Sapiens
  Pancreas
  sig_peptide 56..151: Von Heijne matrix; score 3.80; seq IRTATLVISLARG/WQ
aacactcattttagccagtgtccaggctatcagcagagaaagacaggtgggcagcatggctccgggcgaaaaggaaagcggggagggcccagccaagagcgccctccggaagatacgcacagccaccctggtcatcagcttggcccgaggttggcagcagtgggcgaatgagaacagcatcaggcaggcccaggagcctacaggctggctgccgggagggacccaggactcacctcaagctcctaaaccaatcacaccccggggg

SEQ ID NO: 1275 - DNA, 222 bp, Homo Sapiens
  liver
  sig_peptide 67..192: Von Heijne matrix
  score 3.70
  unsure -33: seq PLLHLFYQHLCFP/VP; position -33 of amino acid sequence; Xaa =  * ,Leu
acaactttatgtctcaaatgtttgtattagagatttttcttgaagtaaaacctacctctactaggaatggaaccaaaaagggggagratgtggtkatttgaaattgaagatagctgtatataccaggacatcccatcgtttgtcttactttacccacttctccatttgttttaccagcatctctgttttcctgttccatgcactagaaatcctgggcccggg

SEQ ID NO: 1276 - DNA, 211 bp, Homo Sapiens
  Lung (cells)
  sig_peptide 131..181: Von Heijne matrix; score 3.60; seq SVLQRCLFSFVTS/VF
cacattctgcactctagcccagaagtcacaaactgatggctctagtgtcaattctgcctgtagtgctgaccactcatacagctggcctgcttccctgatttatctattagcaactcctacttctggccatatggaattttgttcagttcttcaaaggtgcctattctcctttgtcacttcggtctttcatatgctgttccctctgcctggg

SEQ ID NO: 1277 - DNA, 264 bp, Homo Sapiens
  liver
  sig_peptide 196..249: Von Heijne matrix; score 3.60; seq IYVLLFFLLMKFS/FD
taaactaagagtgacatgaccagatttggacttgacaaaggtgcctagaaatgaatgaaggacagttataacagttcacccacagaaacatagagtgcatttctgtcgatatcaaaggaacttagtggagaaatgacaacgacctggatgaaagccctggcttgacttggggacccagtacagggtcaacaaactatggcagagagccaaatctacgtgctgcttttttttttgttaatgaagttttcttttgacacacgaggg

SEQ ID NO: 1278 - DNA, 93 bp, Homo Sapiens
  Liver
  sig_peptide 13..66: Von Heijne matrix; score 3.60; seq ACSLSSGPLQINA/LP
aaaaaactctgaatgcagacaaacaatgcttgttccctgtcctctggccctttgcaaataaatgccttaccagacctgccctgccaccccggg

SEQ ID NO: 1279 - DNA, 390 bp, Homo Sapiens
  Large intestine
  sig_peptide 304..381: Von Heijne matrix; score 3.60; seq KVLMGLLCNQTAA/KR
caaatattccctcctctggggaacttctaattccccagcagaaatcatgcctccagtgacggtccatgcaggcttctggagcgttgggcaatcttcctcatctgtggacttgctggcctctttccccttggcttcttgaggcctgcgctgcatctgatttctctgtctcgggggcctagcatggtcattggccctcccagtgtttcctggatgatcatcgtgctgttcctgagtcagggctgccattggaggtgacatctgtgactgcaacctgtgcctgaattggtgggcggaacctgctcaatgggccagaacaatgcttccttccactgcccctgcctgaaagtcctcatgggcctcctttgcaatcaaactgctgccaagagacct

SEQ ID NO: 1280 - DNA, 124 bp, Homo Sapiens
  Liver
  sig_peptide 29..70: Von Heijne matrix; score 3.60; seq LPLLSVMWSPIAP/LT
acacctttctatctgactacctgccctaatgttgcccttactctcagtaatgtggtctcctattgcgccactcacagtaggatccaaggacccatgccactttataccagttcatgacgagatg

SEQ ID NO: 1281 - DNA, 179 bp, Homo Sapiens
  Thyroid
  sig_peptide 87..155: Von Heijne matrix; score 3.60; seq WITCPPTFHGCRA/LF
attcaaagtacatttgacaacccactgcaagttgtggcatacatgggtgccatgaaccatgataccaactacagctttcaggttcaatgtggcttaattgtggtggcctacaaagatggatcacctgcccacccacatttcatggatgcagagctctgttcccagtactggacgccggg

SEQ ID NO: 1282 - DNA, 145 bp, Homo Sapiens
  Lung (cells)
  sig_peptide 26..121: Von Heijne matrix; score 3.60; seq LGVLTFILQRTTC/LN
actctgccgggtggatgctttctccatgtggcaaggctgtaactgttcacagctgtctgaaacagcagtggaccaggagcagcttggagttttaactttcattttacaaagaacaacatgtttgaatgtttcagcaggcaagagg

SEQ ID NO: 1283 - DNA, 211 bp, Homo Sapiens
  Lung (cells)
  sig_peptide 86..196: Von Heijne matrix; score 3.60; seq LVTLLASKSPSCP/LH
aggggctgtkdgttgctgcagcaacactgackdatacactgcaagctcagtgtattagtcagctctgatattctagcattcttgaatgtgtctcccccatccccaggttgtctcttctaattttcacatcctcatcttcctcctgcccacgaagatgctcgtgacacttctcgchtcaaaatctccgagttgcccccttcaccccctacgg

SEQ ID NO: 1284 - DNA, 333 bp, Homo Sapiens
  Pancreas
  sig_peptide 1..222: Von Heijne matrix
  score 3.50
  unsure -67: seq ECLNLLLSSGADL/RR
  position -67 of amino acid sequence
  unsure -59: Xaa = Gly,Arg
  position -59 of amino acid sequence
  unsure 12: Xaa = Leu,Arg
  position 12 of amino acid sequence
  unsure 20: Xaa = Asp,His
  position 20 of amino acid sequence
  unsure 37: Xaa = Asp,Tyr; position 37 of amino acid sequence; Xaa = Lys,Gln,Arg
atgcacttagctgttctctttrgattctctgactgttgtcgtaagcktctttcctcaggtcagttgtacagcattgtgtcttcactcagcaatgagcatgtgctttcagctgggtttgacatcaatacacctgacaaccttggccgtacctgtcttcatgctgctgcttccggagggaatgttgaatgtcttaatttgctgttgagcagtggagctgacttgaggaggagggacaaatttggcaggaccccactgsactatgcagctgctaacggtagckaccagtgtgcagtaacattggtgactgcyggggcaggtgtcaacgagggcmrg

SEQ ID NO: 1285 - DNA, 107 bp, Homo Sapiens
  Thyroid
  sig_peptide 9..80: Von Heijne matrix; score 3.50; seq LHDCFLSVFQVLS/SI
gaagatggatgtccttccaatggtgtggctggcagtggggtttgcatgactgcttcttgtctgtgtttcaagtgctctcatctattggtttggtttcctttcttttt

SEQ ID NO: 1286 - DNA, 220 bp, Homo Sapiens
  Thyroid
  sig_peptide 50..109: Von Heijne matrix
  score 3.50
  unsure 19: seq KFCLICLLTFIFH/HC; position 19 of amino acid sequence; Xaa =  * ,Gln
gagcggagaggcagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagayagcatcgtggaatgacagaattggagccaagcaaattttcaaagcaagcccgcggg

SEQ ID NO: 1287 - DNA, 317 bp, Homo Sapiens
  Lung
  sig_peptide 87..161: Von Heijne matrix; score 3.50; seq IFLGKSLFSLLEA/MI
agagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggagg

SEQ ID NO: 1288 - DNA, 392 bp, Homo Sapiens
  Large intestine
  sig_peptide 15..92: Von Heijne matrix
  score 7.60
  misc_feature 40..94: seq FLLLVAAPRWVVS/EM; blastn; identity 92; region 1..55; id H30111; est
ggtttctgagagtcatggatctcatgtgcaggaaagtgaagcacctgttgttcttcctcctgctggtggcggctcccagatgggtcgtgtccgaaatgcagattgaggagtcgggcccaggcctggtgaagccctcggagaccctgaccctcacctgcaatgtctttggtggcgccatcaacactaatgcttattactgggcctgggtccgccagtccccagggaagggtctggagtggattggtagtgtttattatagtggcagcacctactacaacccgtccctcaagagtcgagtcaccatgtccatggccacgtccaggaatcagttctccctgcagatgagttctgtgatggccacagacacggctgtctattattgtgcgagacaa

SEQ ID NO: 1289 - DNA, 253 bp, Homo Sapiens
  Lung (cells)
  sig_peptide 65..220: Von Heijne matrix
  score 6.60
  misc_feature 91..253: seq FFAVLFFLWRSFX/SV; blastn; identity 98.8000030517578; region 109..271
  id HSU73682
  misc_feature 220..253: vrt; blastn; identity 94; region 1..34
  id M78620
  est
  misc_feature 7: n=a, g, c or t
  unsure -1: position -1 of amino acid sequence; Xaa = Gly,Arg
atatgangtgcctggtagaactttatttacatgttaggaaattttaacatgagcttttcaagaaatggaattgaaaagtccagaggaagaggttgtggcagcactgcctgaaggtatgagaccagattctaatctttatggttttccatgggaattggtgatatgtgcagctgttgttggattttttgctgttctcttttttttgtggagaagttttrgatcggttaggagtcggctttatgtgggacgaggg

SEQ ID NO: 1290 - DNA, 407 bp, Homo Sapiens
  Thyroid
  sig_peptide 177..293: Von Heijne matrix
  score 6.60
  misc_feature 213..303: seq LALVLAWLSTYVA/DS; blastn; identity 100; region 141..231
  id AA040646
  misc_feature 306..389: est; blastn; identity 95; region 233..316
  id AA040646
  misc_feature 144..214: est; blastn; identity 92; region 71..141
  id AA040646
  misc_feature 78..231: est; blastn; identity 98; region 29..182
  id HUML1879
  misc_feature 147..287: est; blastn; identity 98; region 168..308
  id HSC0FB071
  misc_feature 60..113: est; blastn; identity 98; region 1..54
  id R72047
  unsure 21: est; position 21 of amino acid sequence; Xaa = His,Gln
ctgtccctggtataacagcttccgggagaagccggaagagaccggaccctgaacagaatcgcagattgccagcccttttcccgacccctacggaaagacgagtccaggggccgtcctggcgaggtcaaaacatttagtctggtcttttcagcgtggaccctgccagcwgccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccasctggggcatgtggaccacctggtggcaggccaaggcaaccccgagcgcagg

SEQ ID NO: 1291 - DNA, 353 bp, Homo Sapiens
  Pancreas
  sig_peptide 153..275: Von Heijne matrix
  score 5.40
  misc_feature 167..303: seq RLLYIGFLGYCSG/LI; blastn; identity 100; region 110..246
  id H53379
  misc_feature 57..171: est; blastn; identity 97; region 1..115
  id H53379
  misc_feature 308..350: est; blastn; identity 95; region 250..292
  id H53379
  misc_feature 64..303: est; blastn; identity 99; region 1..240
  id N87636
  misc_feature 167..322: est; blastn; identity 97; region 52..207
  id R25125
  misc_feature 115..171: est; blastn; identity 96; region 1..57
  id R25125
  misc_feature 94..205: est; blastn; identity 99; region 1..112
  id W00411
  misc_feature 201..302: est; blastn; identity 98; region 107..208
  id W00411
  misc_feature 57..205: est; blastn; identity 97; region 2..150
  id N83940
  unsure 24: est; position 24 of amino acid sequence; Xaa = Pro,Thr
agtttgggcgctgcaccgcgtgcgccgtgcccgtgagtccggcgcgcagaggaggaggagaaagctgaccgcttaggcccgggtagtggtcgtcgtggttttccttgtagttcgtggtctgagaccaggcctcaagtggaaacggcgtcaccatgatcgcacggcggaacccagaacccttacggtttctgccggatgaggcccggagcctgcccccgcccaagctgaccgacccgcggctcctctacatcggcttcttgggctactgctccggcctgattgataacctgatccggcggaggccgatcgcgacggctggtttgcatcgccagcttctatatatymcggccggc

SEQ ID NO: 1292 - DNA, 195 bp, Homo Sapiens
  Thyroid
  sig_peptide 52..123: Von Heijne matrix
  score 5.20
  misc_feature 53..191: seq VGGLILWLSVGSS/GD; blastn; identity 100; region 27..165
  id T96213
  misc_feature 40..191: est; blastn; identity 99; region 1..152; id AA156832; est
tttggctttagggaattactccataccagctctgagatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcactcgg

SEQ ID NO: 1293 - DNA, 317 bp, Homo Sapiens
  Lung
  sig_peptide 210..251: Von Heijne matrix
  score 5.00
  misc_feature 248..317: seq CARALLLACSSRG/RH; blastn; identity 95; region 1..70
  id T27030
  misc_feature 252..317: est; blastn; identity 95; region 2..67
  id SSC6F01
  est
  misc_feature 266: n=a, g, c or t
acacttccagctgctccctccaaagtttgtcctagtttcccccttcccagctctccccattcgcagsctcttccatcttcaactcttcttccckgctvacstcktmcctcvtccgatggtctctccttggcttckctccacsccgcttgcytcttctctagtctttccctggccctggcattagtctccttaccctgtgccctgtcccaatgtgtgcccgggctttgctccttgcgtgcagttcgaggggmagacatcgtttggcntgtcagtgttcaacctcagcaacgccatcatgggcagcggcatcctggggc

SEQ ID NO: 1294 - DNA, 367 bp, Homo Sapiens
  Lung (cells)
  sig_peptide 44..181: Von Heijne matrix
  score 4.70
  misc_feature 200..369: seq IICCVFLLLAIVG/YV; blastn; identity 98; region 109..278
  id H38087
  misc_feature 58..129: est; blastn; identity 94; region 41..112
  id H38087
  misc_feature 200..360: est; blastn; identity 98; region 63..223
  id R85713
  misc_feature 64..129: est; blastn; identity 100; region 1..66; id R85713; est
aagagagagcgcgggcggccgccggggctggtcgcctgcagggatgggggacgagcggccccactactacgggaaacacggaacgccacagaagtatgatcccactttcaaaggacccatttacaataggggctgcacggatatcatatgctgtgtgttcctgctcctggccattgtgggctacgtggctgtaggcatcatagcctggactcatggagaccctcgaaaggtgatctaccccactgacagccggggcgagttctgcgggcagaagggcacaaaaaacgagaacaaaccctatctgttttatttcaacattgtgaaatgtgccagccccctggttctgctggaattccaatgtcccact

SEQ ID NO: 1295 - DNA, 327 bp, Homo Sapiens
  Lung (cells)
  sig_peptide 85..132: Von Heijne matrix
  score 4.50
  misc_feature 85..328: seq RLLLRRFLASVIS/RK; blastn; identity 98.8000030517578; region 1..244
  id HSU78678
  misc_feature 85..328: vrt; blastn; identity 97; region 20..263
  id N41898
  misc_feature 98..328: est; blastn; identity 95; region 38..268; id H69272; est
ccccccgagggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccggcg

SEQ ID NO: 1296 - DNA, 378 bp, Homo Sapiens
  Lung (cells)
  sig_peptide 109..177: Von Heijne matrix
  score 4.40
  misc_feature 203..340: seq QFILLGTTSVVTA/AL; blastn; identity 91; region 33..170
  id T50032
  misc_feature 329..376: est; blastn; identity 100; region 160..207
  id T50032
  misc_feature 170..210: est; blastn; identity 97; region 1..41
  id T50032
  est
  misc_feature 55: n=a, g, c or t
  unsure 42: position 42 of amino acid sequence
  unsure 67: Xaa = Asp,Asn,Tyr; position 67 of amino acid sequence; Xaa = Asp,Glu
aaggttaggccgggggggtgcggtcctggtcggaaggagghsbakwsycgmgvvngtcaccaggcctatccttggcgccacagtcggccaccggggctcgccgccgtcatggagagcggagggcggccctcgctgtgccagttcatcctcctgggcaccacctctgtggtcaccgccgccctgtactccgtgtaccggcagaaggcccgggtctcccaagagctcaagggagctaaaaaagttcatttgggtgaagatttaaagagtattctttcagaagctccaggaaaatgcgtscctdatgctgtyatagaaggagctgtgcggtctgttaaagaaacgcttaacagccagtttgtggaaaactgcaagggggas

SEQ ID NO: 1297 - DNA, 267 bp, Homo Sapiens
  Liver
  sig_peptide 49..120: Von Heijne matrix
  score 16.40
  misc_feature 186..261: seq LLLLLLLASLTSG/SV; blastn; identity 98; region 20..95
  id T48277
  misc_feature complement(185..261): est; blastn; identity 100; region 140..216; id T48278; est
aagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggccctggg

SEQ ID NO: 1298 - DNA, 343 bp, Homo Sapiens
  Large intestine
  sig_peptide 107..175: Von Heijne matrix
  score 14.40
  misc_feature 69..297: seq LGLLLFLLPGSLG/AE; blastn; identity 96; region 25..253
  id C16912
  misc_feature 181..269: est; blastn; identity 94; region 64..152
  id T68684
  misc_feature 133..173: est; blastn; identity 90; region 18..58
  id T68684
  est
  misc_feature 68,311,314..315: n=a, g, c or t
  unsure 46: position 46 of amino acid sequence
  unsure 47: Xaa =  * ,Ala,Cys,Asp,Glu,Gly,His,Lys,Asn,Pro,Gln,Arg,Ser,Thr,Trp,Tyr; position 47 of amino acid sequence; Xaa = Ala,Cys,Asp,Phe,Gly,His,Ile,Leu,Asn,Pro,Arg,Ser,Thr,Val,Tyr
acaggatgtgagagaggaactggggtctccagtcacgggagccaggagccggccagggccgcaggagngaagggagcgaggctgaagggaacgtcgtcctctcagcatgggggtcccgcggcctcagccctgggcgctggggctcctgctctttctccttcctgggagcctgggcgcagaaagccacctctccctcctgtaccaccttaccgcggtgtcctcgcctgccccggggactcctgccttctgggtgtccggctggctgggcccgcagcagtacctgagctacaatagcctgcggggcgaggcgnvsnntgtggagcttgggtctgggaaaaccagg

SEQ ID NO: 1299 - DNA, 284 bp, Homo Sapiens
  Liver
  sig_peptide 132..185: Von Heijne matrix
  score 10.30
  misc_feature 25..177: seq SLLLSVLLAQVWL/VP; blastn; identity 100; region 1..153; id T60354; est
agaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccagggaggaagaggaatgg

SEQ ID NO: 1300 - DNA, 607 bp, Homo Sapiens
  Pancreas
  sig_peptide 23..70: Von Heijne matrix
  score 9.50
  misc_feature 23..517: seq ITVLAALLACASS/CG; blastn; identity 96.4000015258789; region 1..495
  id S82198
  misc_feature 155..266: vrt; blastn; identity 97; region 118..229
  id T47757
  misc_feature 64..155: est; blastn; identity 95; region 26..117
  id T47757
  unsure 14: est
  position 14 of amino acid sequence
  unsure 53: Xaa = Glu,Val
  position 53 of amino acid sequence
  unsure 96: Xaa = Asp,Glu,Val
  position 96 of amino acid sequence
  unsure 97: Xaa = Arg,Ser,Thr
  position 97 of amino acid sequence
  unsure 100: Xaa = Leu,Ser,Trp
  position 100 of amino acid sequence
  unsure 126: Xaa = Leu,Arg
  position 126 of amino acid sequence
  unsure 145: Xaa = Leu,Val
  position 145 of amino acid sequence
  unsure 148: Xaa = Ala,Gly,Pro,Arg
  position 148 of amino acid sequence
  unsure 151: Xaa = Ser,Thr
  position 151 of amino acid sequence
  unsure 155: Xaa = Asp,Val
  position 155 of amino acid sequence
  unsure 170: Xaa = Ala,Pro; position 170 of amino acid sequence; Xaa = Phe,Ile
ggccagtcctgagcacctaaccatgttgagcatcactgtcctcgctgcgctcttggcctgtgcctccagctgtggggtgcccagcttcccgcccaacctatccgcccgagwrgtgggaggagaggatgcccggccccacagctggccctggcagatctccctccagtacctcaagaacgacacgtggaggcatacgtgtggcgggactttgattgctagcaacttcgwmctcactgccgcccactgcatcagcaacacccggacctaccgtgtggccgtgggaaagaacaacctggaggtggaagacgaagaaggatccctgtttgtgggtgtggacaccatccacgtccacaagasmtbgaatgccckcctgttgcgcaatgatattgccctcatcaagcttgcagagcatgtggagctgagtgacaccatccaggtggcstgcstgccagagaaggactccctgctccccaaggactacccstgctatgtcagccggctgssgccgcckwctggaggggwytccggtggcscactgaactgccagttggagaacggttcctgggaggtgtttggcwtcgtcagctttggctcccggcggggctgc

SEQ ID NO: 1301 - DNA, 392 bp, Homo Sapiens
  Pancreas
  sig_peptide 24..71: Von Heijne matrix
  score 9.50
  misc_feature 156..267: seq ITVLAALLACASS/CG; blastn; identity 97; region 118..229
  id T47757
  misc_feature 65..156: est; blastn; identity 94; region 26..117
  id T47757
  unsure 24: est
  position 24 of amino acid sequence
  unsure 62: Xaa = Lys,Asn,Arg,Ser
  position 62 of amino acid sequence
  unsure 85: Xaa = Asp,Asn; position 85 of amino acid sequence; Xaa = Phe,Tyr
aagccagtcctgagcacctaaccatgttgggcatcactgtcctcgctgcgctcttggcctgtgcctccagctgtggggtgcccagcttcccgcccaacctatccgcccgagtggtgggaggagaggatgcccggccccacarmtggccctggcagatctccctccagtacctcaagaacgacacgtggaggcatacgtgtggcgggactttgattgctagcaacttcgtcctcactgccgcccactgcatcagcracacccggacctaccgtgtggccgtgggaaagaacaacctggaggtggaagacgaagaaggatccctgtwtgtgggtgtggacaccatccacgtccacaggagatggaatgccctcctgttgcgcaatgatattgcc

SEQ ID NO: 1302 - DNA, 240 bp, Homo Sapiens
  Colon
  sig_peptide 85..198: Von Heijne matrix
  score 8.80
  misc_feature 102..240: seq LLLPLLSLPVTTP/WT; blastn; identity 97; region 83..221
  id H83276
  misc_feature 66..240: est; blastn; identity 97; region 23..197
  id H51676
  misc_feature 91..240: est; blastn; identity 95; region 71..220
  id AA007645
  misc_feature 16..68: est; blastn; identity 98; region 1..53
  id AA007645
  misc_feature 64..240: est; blastn; identity 99; region 74..250
  id W95024
  misc_feature 119..161: est; blastn; identity 97; region 417..459
  id AA149660
  misc_feature 19..52: est; blastn; identity 100; region 314..347
  id AA149660
  misc_feature 66..95: est; blastn; identity 93; region 361..390; id AA149660; est
agcactctagttcaagagtgaaaagtctcacccaggaggaacagccctccttgaagcaatggcagggccagcagggaggtgggcatggcagggaatggagagagtgagccagacagacttcacctccttactggacacagggtcaagggcgagtttcaattgctgctccctttactttctctacctgtgactactccctggaccaatcctgaggagggcacattttccagaagccacggg

SEQ ID NO: 1303 - DNA, 320 bp, Homo Sapiens
  Large intestine
  sig_peptide 51..92: Von Heijne matrix
  score 8.70
  misc_feature complement(241..322): seq LWWLVLLLLPTLK/SV; blastn; identity 100; region 27..108
  id HSBC2H071
  misc_feature complement(241..322): est; blastn; identity 100; region 328..409
  id N27679
  misc_feature complement(241..322): est; blastn; identity 98; region 144..225
  id W28299
  misc_feature complement(254..322): est; blastn; identity 95; region 199..267
  id C02881
  misc_feature complement(241..294): est; blastn; identity 94; region 111..164; id T60610; est
ttttcagcaactaaaaaagccacaggagttgaactgctaggattctgactatgctgtggtggctagtgctcctactcctacctacattaaaatctgttttttgttctcttgtaactagcctttaccttcctaacacagaggatctgtcactgtggctctggcccaaacctgaccttcactctggaacgagaacagaggtttctacccacaccgtcccctcgaagccggggacagcctcaccttgctggcctctcgctggagcagtgccctcaccaactgtctcacgtctggaggcactgactcgggcagtgcaggtagct

SEQ ID NO: 1304 - DNA, 256 bp, Homo Sapiens
  Liver
  sig_peptide 98..184: Von Heijne matrix
  score 8.50
  misc_feature 114..200: seq LLGLLMAACFTFC/LS; blastn; identity 100; region 51..137
  id AA120830
  misc_feature 197..252: est; blastn; identity 91; region 135..190
  id AA120830
  est
  misc_feature 56: n=a, g, c or t
  unsure 15: position 15 of amino acid sequence
  unsure 17: Xaa = Asp,Glu; position 17 of amino acid sequence; Xaa = Ser,Thr
agcgtttgcgcagggggagctggtcgccgccgcggccgcctggaattgtgggagtngtgtctgccactcggctgccggaggcggaargtccgtgactatggctccccaragcctgccttcatctaggatggctcctctgggcatgctgcttgggctgctgatggccgcctgcttcaccttctgcctcagtcatcagaacctgaaggagtatgccctgaccaacccagakaagascagcaccaaagaaacggaaggg

SEQ ID NO: 1305 - DNA, 278 bp, Homo Sapiens
  Lung
  sig_peptide 69..137: Von Heijne matrix
  score 8.10
  misc_feature 25..247: seq LLLVTVSSNLAIA/IK; blastn; identity 99; region 1..223; id T94936; est
aatccagaatacatttccawcaagagcactggccaagtcagcttcttctgagagagtctctagaagacatgatgctacactcagctttgggtctctgcctcttactcgtcacagtttcttccaaccttgccattgcaataaaaaaggaaaagaggcctcctcagacactctcaagaggatggggagatgacatcacttgggtacaaacttatgaagaaggtctcttttatgctcaaaaaagtaagaagccattaatggttattcatcacctggacggg

SEQ ID NO: 1306 - DNA, 290 bp, Homo Sapiens
  Liver
  sig_peptide 33..110: Von Heijne matrix
  score 7.60
  misc_feature 15..203: seq LITLCLVCIVANA/LL; blastn; identity 99; region 6..194
  id T55097
  misc_feature 199..262: est; blastn; identity 93; region 189..252
  id T55097
  misc_feature 22..203: est; blastn; identity 99; region 10..191
  id W86026
  misc_feature 239..283: est; blastn; identity 91; region 225..269
  id W86026
  misc_feature 30..283: est; blastn; identity 96; region 1..254
  id H49257
  misc_feature 42..283: est; blastn; identity 98; region 1..242
  id W84512
  misc_feature 35..214: est; blastn; identity 90; region 1..180
  id T69237
  est
  misc_feature 252..253: n=a, g, c or t
  unsure 48: position 48 of amino acid sequence; Xaa = any one of the twenty amino acids
aactcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccggggattgcagccgttcgggcagggggcaagnnstgctgtggtgctgggtgctgtggaaaccggctgcgg

SEQ ID NO: 1307 - DNA, 197 bp, Homo Sapiens
  Lung (cells)
  sig_peptide 90..158: Von Heijne matrix
  score 7.50
  misc_feature 78..192: seq LVLLLTLPLHLMA/LL; blastn; identity 95; region 65..179
  id T60981
  misc_feature 13..75: est; blastn; identity 92; region 1..63; id T60981; est
acagcgggaggggacgccagcgcctgcagaggctgagcagggaaaaagccagtdccccagcggaagcacagctcabbagctggtctgccatggacatcctggtcccactcctgcagctgctggtgctgcttcttaccctgcccctgcacctcatggctctgctgggctgctggcagcccctgtgcaaaagctttggg

SEQ ID NO: 1308 - DNA, 175 bp, Homo Sapiens
  Liver
  sig_peptide 107..151: Von Heijne matrix
  score 7.50
  misc_feature complement(112..142): seq FLVLFSFFNIALC/AP; blastn; identity 93; region 187..217
  id AA146544
  misc_feature complement(112..142): est; blastn; identity 93; region 187..217; id AA146541; est
attcttttttcggacttggaagtttttatgattagtgtctttctggcagacttcagtgacttttctagaagcaggtaagacctagcatgctttgtcctgtgcgttgatgccttttttggttttgttttcgttttttaacattgcattatgtgctccaaggaaatttgcaagaaag

SEQ ID NO: 1309 - DNA, 383 bp, Homo Sapiens
  Pancreas
  sig_peptide 60..116: Von Heijne matrix
  score 6.80
  misc_feature 49..192: seq AIVALAVCAALHA/SE; blastn; identity 98; region 43..186
  id R38459
  misc_feature 188..240: est; blastn; identity 100; region 183..235
  id R38459
  misc_feature 7..50: est; blastn; identity 100; region 2..45; id R38459; est
aatttcctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagagg

SEQ ID NO: 1310 - DNA, 352 bp, Homo Sapiens
  Lung
  sig_peptide 29..88: Von Heijne matrix
  score 6.80
  misc_feature 2..354: seq GLLWMLFVSELRA/AT; blastn; identity 99; region 2..354
  id HUM517F10B
  misc_feature 75..230: est; blastn; identity 100; region 1..156
  id H04128
  misc_feature 225..343: est; blastn; identity 98; region 152..270
  id H04128
  misc_feature 309..354: est; blastn; identity 97; region 1..46
  id AA099288
  unsure 86: est; position 86 of amino acid sequence; Xaa = Glu,Lys,Gln
aavcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtgvaagattct

SEQ ID NO: 1311 - DNA, 293 bp, Homo Sapiens
  Thyroid
  sig_peptide 102..167: Von Heijne matrix
  score 6.80
  misc_feature 36..241: seq VSLVLLMPGPCDG/LF; blastn; identity 98; region 1..206
  id T08694
  misc_feature 33..233: est; blastn; identity 98; region 1..201
  id AA095665
  misc_feature 56..241: est; blastn; identity 97; region 18..203
  id R35300
  misc_feature 97..211: est; blastn; identity 98; region 1..115
  id AA093039
  misc_feature 118..292: est; blastn; identity 95; region 1..175
  id HSC1GA121
  est
  misc_feature 272,280..281: n=a, g, c or t
  unsure 10: position 10 of amino acid sequence
  unsure 38: Xaa = Ala,Cys,Phe,Gly,Leu,Pro,Arg,Ser,Val
  position 38 of amino acid sequence
  unsure 39: Xaa =  * ,Cys,Phe,His,Leu,Pro,Gln,Arg,Ser,Trp,Tyr; position 39 of amino acid sequence; Xaa = Gly,Ser
ctcacttctgcctgaattgggaagcgctgcaaggacaaccggctggggtccttgcgcgccgcggctcagggaggagcaccgactgcgccgcaccctgagagatggttggtgccatgtggaaggtgattgtttcgctggtcctgttgatgcctggcccctgtgatgggctgtttcgctccctatacagaagtgttbbcatgccacctaagggagactcaggacagccattatttctcaccccttacattgaagctgggaagatccaaaaaggnagagaaynnrgtttggtcggg

SEQ ID NO: 1312 - DNA, 263 bp, Homo Sapiens
  Lung (cells)
  sig_peptide 81..200: Von Heijne matrix
  score 6.10
  misc_feature complement(1..158): seq ICIGILVLPFIRC/CC; blastn; identity 98; region 160..317
  id N66156
  misc_feature complement(155..262): est; blastn; identity 99; region 55..162
  id N66156
  misc_feature 167..262: est; blastn; identity 96; region 8..103
  id HUMGS02822
  est
  misc_feature 12: n=a, g, c or t
aagaataggatnattcactggtaataatagagtcattaagaaatattaagcattgcagctaaaaattgaacaaccctgtaatgatacatttaagaattattcaaaggtgctacatggcagggttagagaataaaaagaacgtggtgtttgaagcaaaacagatctgtattggcatcttggttctcccttttatcagatgttgttgccttgtgcaaatcacattttctctgagtctccattttctcatttataacatgcggcgg

SEQ ID NO: 1313 - DNA, 347 bp, Homo Sapiens
  Lung (cells)
  sig_peptide 54..119: Von Heijne matrix
  score 5.90
  misc_feature 61..344: seq LIYILWQLTGSAA/SG; blastn; identity 98; region 18..301
  id H73135
  misc_feature 49..109: est; blastn; identity 100; region 1..61; id AA251602; est
aatacctaagagggaagtggcttcatttcagtggctgacttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagtkgactctattgtctggaccttcaacacaacccctcttgtcaccatacagccagaagggggcactatcatagtgacccaaaatcgtaatagggagagagtagacttcccagatggaggctactccctgaagctcagcaaactgaagaagggg

SEQ ID NO: 1314 - DNA, 394 bp, Homo Sapiens
  Thyroid
  sig_peptide 56..232: Von Heijne matrix
  score 5.70
  misc_feature 86..206: seq ALLDLCAAPXGWL/QV; blastn; identity 100; region 81..201
  id AA159880
  misc_feature 5..85: est; blastn; identity 100; region 1..81
  id AA159880
  misc_feature 244..309: est; blastn; identity 100; region 239..304
  id AA159880
  misc_feature 239..354: est; blastn; identity 94; region 1..116
  id AA109004
  unsure -4: est
  position -4 of amino acid sequence
  unsure 40: Xaa = Gly,Arg; position 40 of amino acid sequence; Xaa = Lys,Arg
aagtgtggagaaagcggctctgggtctagattgagggatactccccctttccaccatgggcaagaagggcaaagttggcaagagccgacgagacaagttttatcacttggcgaaggagacgggttaccgttcccgatctgctttcaagctgatccagctcaatcgccgctttcagttcctgcagaaagcccgagccttgctggacctgtgtgctgcgccasggggatggctgcaggtagctgccaagtttatgcctgtatccagccttattgtgggagtggacctggttccaatcaagcctctccccaatgtggtgactctccaggaggacatcacaacagaacgttgtargcaaaggcactggacatcagcctcagctctggaraggaagatg

SEQ ID NO: 1315 - DNA, 299 bp, Homo Sapiens
  liver
  sig_peptide 75..170: Von Heijne matrix
  score 5.70
  misc_feature 22..296: seq FGLVXVGTALALA/RK; blastn; identity 96; region 68..342
  id R21563
  misc_feature 23..176: est; blastn; identity 95; region 1..154
  id R23529
  misc_feature 158..296: est; blastn; identity 94; region 135..273
  id R23529
  misc_feature 3..271: est; blastn; identity 98; region 1..269
  id HSC2LG091
  misc_feature 22..179: est; blastn; identity 94; region 68..225
  id R20326
  misc_feature 180..262: est; blastn; identity 97; region 224..306
  id R20326
  misc_feature 198..296: est; blastn; identity 97; region 168..266
  id T77109
  misc_feature 26..78: est; blastn; identity 90; region 5..57
  id T77109
  misc_feature 78..108: est; blastn; identity 96; region 56..86
  id T77109
  misc_feature 115..145: est; blastn; identity 96; region 91..121
  id T77109
  unsure -9: est
  position -9 of amino acid sequence
  unsure 29: Xaa = Cys,Ser; position 29 of amino acid sequence; Xaa = Ala,Gly
aacggagggccagagagtcacggcggttttcgtaacaccccagggcctgtaaggtttggtgtttccctttcaagatgccactttcagactttattctggctctkaaggacaatccctactttggggctggatttgggctggtgwgtgtgggcacagccctggccctggcccggaagggtgtccaactgggcctggtggcattccggcgccattacatgatcacactggaagtccctgctcgagacaggagctatgsctggttgcttagctggctcacccgccacagtacccgtactggg

SEQ ID NO: 1316 - DNA, 359 bp, Homo Sapiens
  Large intestine
  sig_peptide 81..137: Von Heijne matrix
  score 5.60
  misc_feature 321..358: seq WVFLVAIIKGVQC/QA; blastn; identity 92; region 241..278
  id SSC1D10
  unsure 45: est
  position 45 of amino acid sequence
  unsure 46: Xaa = Leu,Met; position 46 of amino acid sequence; Xaa = Lys,Gln
acctctgggagaagmrtcccagccccagaattcccaggagtctccgttcggtgatcagcactgaacaccgaggactcaccatggagtttgggctgagctgggttttcctcgttgctattataaaaggtgtccagtgtcaggcacagctcgaggaatctgggggaggcttggtccagcctggagggtccctgagactctcatgtagaggttctggattcaccctcagtgaccactacatgagttggatccgccagtcccctgggaagggamtgmagtgggtcgcctatatcagttacagtggttcaaccatttattatggggactctgtggacggccgattcaccatctccagggacaat

SEQ ID NO: 1317 - DNA, 177 bp, Homo Sapiens
  Lung (cells)
  sig_peptide 46..108: Von Heijne matrix
  score 5.30
  misc_feature 145..176: seq SLFSSLPIFLTWA/HI; blastn; identity 90; region 56..87
  id N87931
  misc_feature 145..176: est; blastn; identity 90; region 287..318
  id C17084
  unsure 9: est; position 9 of amino acid sequence; Xaa = Pro,Gln
caggccttgttcggcatatttgtctctttaaaacacccattcttcatgattttaaggaaaagatcatgctcattattttcttccctcccaatctttctaacatgggcccacataaaacgtgtcccccttctgcmaacatcccttcacaccgcccacaacggccacccccactacggg

SEQ ID NO: 1318 - DNA, 188 bp, Homo Sapiens
  Colon
  sig_peptide 99..146: Von Heijne matrix
  score 5.00
  misc_feature 21..137: seq GLMFVKLVNPCSG/EG; blastn; identity 96; region 178..294
  id AA148442
  misc_feature 144..184: est; blastn; identity 97; region 303..343; id AA148442; est
aagggcggcatggcsctggcgtggactgcggggacggggttggcgcccggcagcacgtgttcctggtttcagaatatttaaaagatgcttcaaagaagatgaaaaatgggctaatgtttgtaaaactggttaacccctgttcaggagaaggagccatttacttgttcaatatgtgtctacagcagcgg

SEQ ID NO: 1319 - DNA, 182 bp, Homo Sapiens
  Lung (cells)
  sig_peptide 66..110: Von Heijne matrix
  score 4.90
  misc_feature 37..181: seq AVVFVFSLLDCCA/LI; blastn; identity 95; region 17..161
  id W24468
  misc_feature 62..181: est; blastn; identity 100; region 3..122
  id W38688
  misc_feature 62..181: est; blastn; identity 97; region 3..122
  id W80906
  misc_feature 71..181: est; blastn; identity 100; region 1..111
  id AA213429
  misc_feature 71..181: est; blastn; identity 100; region 3..113; id AA054464; est
ttcaggggtgggtcggggcatccgagcgggtttgacggaaggagcggcggcgacggaggaggaggatggaggcggtggtgttcgtcttctctctcctcgattgttgcgcgctcatcttcctctcggtctacttcataattacattgtctgatttagaatgtgattacattaatgctagatcg

SEQ ID NO: 1320 - DNA, 349 bp, Homo Sapiens
  Pancreas
  sig_peptide 164..331: Von Heijne matrix
  score 4.70
  misc_feature 141..310: seq FACVPGASXTTLA/FP; blastn; identity 100; region 118..287
  id W25106
  misc_feature 22..105: est; blastn; identity 100; region 1..84
  id W25106
  misc_feature 107..136: est; blastn; identity 100; region 85..114
  id W25106
  misc_feature 142..351: est; blastn; identity 99; region 121..330
  id N31560
  misc_feature 24..112: est; blastn; identity 96; region 1..89
  id N31560
  misc_feature 36..351: est; blastn; identity 98; region 1..316
  id W17036
  misc_feature 141..351: est; blastn; identity 99; region 105..315
  id AA039274
  misc_feature 37..112: est; blastn; identity 97; region 1..76
  id AA039274
  misc_feature complement(107..299): est; blastn; identity 98; region 236..428
  id W72617
  misc_feature complement(32..105): est; blastn; identity 97; region 432..505
  id W72617
  misc_feature complement(321..351): est; blastn; identity 96; region 181..211
  id W72617
  unsure -5: est; position -5 of amino acid sequence; Xaa = Ala,Pro,Ser
agttgccagaaggggcgggacctgcaacgtccgacagaacgaggggacgtaacggaggcaggttggagccgctgccgtcgccatgacccgcggtaaccagcgtgactcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtbccaccacgctcgcgtttcctcctgtagtgctc

SEQ ID NO: 1321 - DNA, 273 bp, Homo Sapiens
  Colon
  sig_peptide 94..150: Von Heijne matrix
  score 4.50
  misc_feature 42..271: seq SVPLLTDAATVSG/AE; blastn; identity 96; region 1..230
  id R20112
  misc_feature 79..271: est; blastn; identity 92; region 91..283
  id W35748
  misc_feature 108..222: est; blastn; identity 93; region 78..192
  id AA074652
  misc_feature 31..81: est; blastn; identity 100; region 1..51
  id AA074652
  misc_feature 222..271: est; blastn; identity 100; region 191..240
  id AA074652
  misc_feature 79..271: est; blastn; identity 91; region 91..283
  id W35757
  misc_feature 79..271: est; blastn; identity 92; region 93..285; id W74958; est
aaagagtgtgtctgcgggagaaagaggagaatcgcccaagcggcctcggaagtcccagggagtggaggcccccgccgtggagccgtgtggtgtatgtgtggtaacaccatgtctgtgcccctgctcaccgatgctgccaccgtgtctggagctgagcgggaaacggccgcggttatttttttacatggacttggagacacagggcacagctgggctgacgccctctccaccatccggctccctcacgtcaagtacatctgtccccatgcgcgg

SEQ ID NO: 1322 - DNA, 371 bp, Homo Sapiens
  Large intestine
  sig_peptide 189..317: Von Heijne matrix
  score 4.30
  misc_feature complement(53..194): seq SLWRLQWLKDASC/DP; blastn; identity 98; region 178..319
  id R00081
  misc_feature complement(202..322): est; blastn; identity 98; region 52..172
  id R00081
  misc_feature complement(322..372): est; blastn; identity 92; region 3..53
  id R00081
  misc_feature complement(202..322): est; blastn; identity 98; region 76..196
  id T53389
  misc_feature complement(104..194): est; blastn; identity 98; region 202..292
  id T53389
  misc_feature complement(322..372): est; blastn; identity 92; region 27..77
  id T53389
  misc_feature complement(70..105): est; blastn; identity 100; region 292..327
  id T53389
  misc_feature complement(247..322): est; blastn; identity 98; region 70..145
  id R50426
  misc_feature complement(322..372): est; blastn; identity 92; region 21..71
  id R50426
  misc_feature complement(202..248): est; blastn; identity 97; region 145..191
  id R50426
  misc_feature 3..194: est; blastn; identity 96; region 1..192
  id H26655
  misc_feature complement(225..322): est; blastn; identity 96; region 71..168
  id R52030
  misc_feature complement(322..372): est; blastn; identity 92; region 22..72
  id R52030
  unsure -42: est
  position -42 of amino acid sequence
  unsure -41: Xaa = Glu,Val
  position -41 of amino acid sequence
  unsure -40: Xaa = Gly,Arg,Trp
  position -40 of amino acid sequence
  unsure -39: Xaa = Ile,Met
  position -39 of amino acid sequence
  unsure 8: Xaa = Pro,Arg
  position 8 of amino acid sequence
  unsure 11: Xaa = Ile,Leu; position 11 of amino acid sequence; Xaa = Ala,Val
ccgtgagtcgtacacttgatggctccctgctagtccgccagaaggcagaggtccaggtgwggcttggagccaatgggaaggtggctgtgattgtcagcaatgaccatgctgggaaactgtgtggggcctgtggaaactttgacggggaccagaccaatgattggcatgactcccaggagaagccagcgatggwgdggatscsagagcgcaggacttctccccatgttatggctgatcagtcatccaccaggaacgaagatttcctgaagaagacctggtccctctggaggttgcagtggctgaaggatgcatcatgtgatccctaccctgctctaccsmttttctgggymacagaggccaaatgtgagagc

SEQ ID NO: 1323 - DNA, 329 bp, Homo Sapiens
  Pancreas
  sig_peptide 249..290: Von Heijne matrix
  score 3.80
  misc_feature 238..329: seq FLLLNCIVAVSQN/MG; blastn; identity 90; region 18..109
  id T29009
  misc_feature 238..329: est; blastn; identity 90; region 13..104
  id R01547
  misc_feature 238..329: est; blastn; identity 90; region 46..137
  id T91432
  unsure 11: est; position 11 of amino acid sequence; Xaa = Gly,Arg
aaaaaaaaggctgatacttcccaggacgcggaggtaacgggccagggccaaagcgactttcgctacttggattggtcggcgtagtttgggcggccggaccttagaaagtcacacatctgcgcgcctgtgcggcccctgcttctgcggatgctgaggcacgtaaaaaaatttgaagaagggaatttcgcggcattcttggcctggcttcctggcgtacascaagttcggaggtgttaaccgctgctgtcatgtttcttttgctaaactgcatcgtcgctgtgtcccaaaacatgggcatcggcaagaacggggacctgccsvggccgcag

SEQ ID NO: 1324 - DNA, 194 bp, Homo Sapiens
  Lung
  sig_peptide 15..56: Von Heijne matrix
  score 3.80
  misc_feature complement(163..192): seq LLVSAAPLGFGQG/VW; blastn; identity 90; region 175..204
  id H33662
  unsure 12: est; position 12 of amino acid sequence; Xaa =  * ,Tyr
aggttgtttactgaatgcttctggtatctgcagccccgctggggttcggacagggggtctggaatagggcttcacaactacagcagggctasgaccctcttggggctggaaggagctggagaggcctctgcaagctgtcacaggctcttggtgctggcactggctcaggctttcacacacacacacgcgcacca

SEQ ID NO: 1325 - DNA, 187 bp, Homo Sapiens
  liver
  sig_peptide 80..127: Von Heijne matrix
  score 3.70
  misc_feature complement(2..174): seq IALTLIPSMLSRA/AG; blastn; identity 100; region 1..173
  id M85423
  misc_feature complement(91..183): est; blastn; identity 98; region 467..559
  id AA126476
  misc_feature complement(28..89): est; blastn; identity 98; region 560..621
  id AA126476
  misc_feature complement(2..32): est; blastn; identity 90; region 616..646
  id AA126476
  misc_feature 47..183: est; blastn; identity 100; region 1..137
  id R33928
  misc_feature 55..183: est; blastn; identity 100; region 14..142
  id H67425
  misc_feature 56..183: est; blastn; identity 100; region 1..128; id W04820; est
accttcttgttatttatgctattctctttgtggctccattcttctttcaatcttctcagcttataaccgtctttcccttatgctaaggatagcccttacactcatcccatctatgctgtcaagggctgctggttggtgctggtacaaggagcccactcagcagttttcttacctttgcctgccgggg

SEQ ID NO: 1326 - DNA, 145 bp, Homo Sapiens
  Lung
  sig_peptide 23..79: Von Heijne matrix
  score 3.70
  misc_feature 71..109: seq LPGLRCSVPGVAA/RL; blastn; identity 97; region 16..54
  id AA129105
  unsure 20: est
  position 20 of amino acid sequence
  unsure 21: Xaa =  * ,Glu,Lys; position 21 of amino acid sequence; Xaa = Ala,Glu
acggcagaagggacgtccccaaatgacactcggaggccgcctccctgggctccggtgctcggtgccgggagtagcggcacggctttctaccccgcctcaggtgcgccagcacgttttctgggcagcatctgtgtgtdaggmaacg

SEQ ID NO: 1327 - DNA, 289 bp, Homo Sapiens
  Liver
  sig_peptide 89..130: Von Heijne matrix
  score 3.60
  misc_feature 23..291: seq AFTLXSLLQAALL/CV; blastn; identity 97; region 1..269
  id T29966
  misc_feature 123..291: est; blastn; identity 97; region 100..268
  id HSC1VD021
  misc_feature 23..124: est; blastn; identity 96; region 1..102
  id HSC1VD021
  misc_feature 56..291: est; blastn; identity 97; region 1..236
  id T35162
  misc_feature 122..291: est; blastn; identity 97; region 41..210
  id R12259
  misc_feature 123..251: est; blastn; identity 96; region 75..203
  id N35783
  misc_feature 48..124: est; blastn; identity 93; region 1..77
  id N35783
  unsure -9: est
  position -9 of amino acid sequence
  unsure 37: Xaa =  * ,Tyr
  position 37 of amino acid sequence
  unsure 38: Xaa = Glu,Gln
  position 38 of amino acid sequence
  unsure 40: Xaa = Leu,Val; position 40 of amino acid sequence; Xaa = Lys,Asn,Arg,Ser,Thr
agtaggaasgcgccgsccgtggaggcgccacgtcccttgcsgcggcgggagagamatcgcttggacttcggggcggcctcggacggccatggcctttaccctgtastcactgctgcaggcagccctgctctgcgtcaacgccatcgcagtgctgcacgaggagcgattcctcaagaacattggctggggaacagaccagggaattggtggatttggagaagagccgggaattaaatcasagstaatgavscttattcgatctgtaagaaccgtgatgagagtgccattg

SEQ ID NO: 1328 - DNA, 356 bp, Homo Sapiens
  Pancreas
  sig_peptide 81..143: Von Heijne matrix
  score 3.50
  misc_feature 243..358: seq LKVVFMVFASLXA/WY; blastn; identity 98; region 99..214
  id R74138
  misc_feature 2..99: est; blastn; identity 92; region 2..99
  id R74138
  misc_feature 243..358: est; blastn; identity 98; region 68..183
  id C18563
  misc_feature 32..99: est; blastn; identity 94; region 1..68
  id C18563
  est
  misc_feature 171: n=a, g, c or t
  unsure -2: position -2 of amino acid sequence
  unsure 9,51: Xaa =  * ,Cys,Asp,Glu,Gly,Tyr
  position 9, 51 of amino acid sequence
  unsure 10: Xaa = Asp,Glu
  position 10 of amino acid sequence
  unsure 52: Xaa = Phe,Ile,Leu,Val; position 52 of amino acid sequence; Xaa = Ala,Thr
acttcctgacccaggggctccgctggctgcggtcgcctgggakytgccgccagggccaggaggggakyggcacctggaagatgcgcccattggctggtggcctgctcaaggtggtgttcatggtcttcgcctccttgkrwgcctggtattcggggtacctgctcgcagasntcattccagatgcacccctgtccagtgctgcctatagcatccgcagcatcggggagaggcctgtcctcaaagctccagtccccaaaaggcaaaaatgtgaccactggactccctgcccatctgasrcctatgcctacaggttactcagcggaggtggcagaagcaagtacgccaaaatctgcttt

SEQ ID NO: 1329 - DNA, 289 bp, Homo Sapiens
  Colon
  sig_peptide 116..181: Von Heijne matrix
  score 3.50
  misc_feature complement(207..287): seq AAPVAAGLGPVIS/RP; blastn; identity 91; region 220..300; id H49636; est
agtcacgctttggtttccgggtcggttctggcaggtctgagcgctccgacttccagaggagcgctgtgcacgtggagaagagcggggactcggcgaccctgccctcccgaccctcatgttcgaagagcctgagtgggccgaggcggccccagtagccgcgggccttgggcccgtaatctcacgacctccgcctgcggcctcctcgcaaaacaagggctccaagcgccgccagctcttggccacattacgggccctagaggcagcatctctttcccagcatccccccatg

SEQ ID NO: 1330 - DNA, 139 bp, Homo Sapiens
  Lung (cells)
  sig_peptide 50..118: Von Heijne matrix
  score 3.50
  misc_feature 34..129: seq ALYNIIYVCGIQG/IT; blastn; identity 96; region 1..96; id W54807; est
accgttgtcaccagccttgtttctagtgtgtatatatgtcgcccccgtgatgcatatatacacaggtattaaatatatcgctctatataatattatatatgtgtgtggtatccaaggaatcacttttatgagggcacgg

SEQ ID NO: 1331 - DNA, 140 bp, Homo Sapiens
  Heart
  sig_peptide 63..122: Von Heijne matrix
  score 15.80
  seq LLLLLLLRHGAQG/KP
  misc_feature 26,29,31: n=a, g, c or t
aacatttgcgggaacrsagagcggansgngngacagcggaggavstggataacaggggaccgatgatgtggcgaccatcagttctgctgcttctgttgctactgaggcacggggcccaggggaagccatccccagacgca

SEQ ID NO: 1332 - DNA, 404 bp, Homo Sapiens
  kidney
  sig_peptide 285..359: Von Heijne matrix
  score 14.00
  seq LAMLALLSPLSLA/QY
  misc_feature 195: n=a, g, c or t
  unsure 7: position 7 of amino acid sequence
  unsure 8: Xaa = His,Gln; position 8 of amino acid sequence; Xaa =  * ,Asp,Glu,Tyr
actagttaaaagtaagtgggaaaagagtaaacgcgcgactccagcgcgcggctacctacgcttggtgcttgctttctccagccatcggagaccagagccgccccctctgctcgagaaaggggctcagcggcggcggaagcggagggggaccaccgtggagagcgcggtcccagcccggccactgcggatccctgnaaccaaaaagctcctgctgcttctgtaccccgcctgtccctcccagctgcgcagggccccttcgtgggatcatcagcccgaagacagggatggagaggcctctgtgctcccacctctgcagctgcctggctatgctggccctcctgtcccccctgagcctggcacagtatgacagctggccccadkamcccgagtacttccagcaaccg

SEQ ID NO: 1333 - DNA, 231 bp, Homo Sapiens
  Dystrophic muscle
  sig_peptide 67..120: Von Heijne matrix; score 12.30; seq HILFLLLLPVAAA/QT
aacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggct

SEQ ID NO: 1334 - DNA, 161 bp, Homo Sapiens
  kidney
  sig_peptide 69..134: Von Heijne matrix; score 12.20; seq LALALGLAQPASA/RR
atttctccatcctcagtctttgcaaggcgacagctgtgccagccgggctctggcaggctcctggcagcatggcagtgaagcttgggaccctcctgctggcccttgccctgggcctggcccagccagcctctgcccgccggaagctgctggtgtttctgctg

SEQ ID NO: 1335 - DNA, 284 bp, Homo Sapiens
  Kidney
  sig_peptide 63..122: Von Heijne matrix; score 11.90; seq LVLEFLLLSPVEA/QQ
aaaaaacctgtggacgccgacccgggaccgccgctggctggctgctggctcactcgaccgtcatggagaccctgggggcccttctggtgctggagtttctgctcctctccccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccggg

SEQ ID NO: 1336 - DNA, 233 bp, Homo Sapiens
  kidney
  sig_peptide 63..110: Von Heijne matrix
  score 11.30
  seq PLLLSSLLGGSQA/MD
  misc_feature 179: n=a, g, c or t
  unsure 24: position 24 of amino acid sequence; Xaa = Ala,Ser
aactcacagcacgaccagagaacaggcctgtctcaggcaggccctgcgcctcctatgcggagatgctactgccactgctgctgtcmtcgctgctgggcgggtcccaggctatggatgggagattctggatacgagtgcaggagtcagtgatggtgccggagggcctgtgcatctctgtnkccctgctctttctcctacccccgacaagactggacagggtctaccccagccgg

SEQ ID NO: 1337 - DNA, 439 bp, Homo Sapiens
  kidney
  sig_peptide 32..73: Von Heijne matrix; score 10.70; seq LWLLFFLVTAIHA/EL
aactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccaacccgg

SEQ ID NO: 1338 - DNA, 169 bp, Homo Sapiens
  kidney
  sig_peptide 20..100: Von Heijne matrix
  score 10.70
  unsure 19: seq LPLLCLFLQGATA/VL; position 19 of amino acid sequence; Xaa = His,Gln
agagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcamcggaagcttggg

SEQ ID NO: 1339 - DNA, 204 bp, Homo Sapiens
  Dystrophic muscle
  sig_peptide 40..156: Von Heijne matrix
  score 10.60
  unsure -15: seq ALALLLVLPLLWP/CS
  position -15 of amino acid sequence
  unsure 10: Xaa = Ala,Thr; position 10 of amino acid sequence; Xaa =  * ,Tyr
actgccctgccctggcctgaccccaggcctactgagtccatgaaatggccctggacctgccttgccatcctctgtcctggccctgtattgtccccaccatgctctggtccarcgcttgccctagccctgttgctagtcctgccactgctatggccctgctctgtttttggccatgccctgtgctamcctagccctgcccgaagg

SEQ ID NO: 1340 - DNA, 351 bp, Homo Sapiens
  kidney
  sig_peptide 28..96: Von Heijne matrix
  score 10.00
  unsure 31: seq PLLGLLLSLPAGA/DV; position 31 of amino acid sequence; Xaa = Gly,Trp
aaccgagctggatttgtatgttgcaccatgccttcttggatcggggctgtgattcttcccctcttggggctgctgctctccctccccgccggggcggatgtgaaggctcggagctgcggagaggtccgccaggcgtacggtgccaagggattcagcctggcggacatcccctaccaggagatcgcakgggaacacttaagaatctgtcctcaggaatatacatgctgcaccacagaaatggargacaagttaagccaacaaagcaaactcgaatttgaaaaccttgtggaagagacaagccattttgtgcgcaccacttttgtgtccaggcataagaaatttgacggtagg

SEQ ID NO: 1341 - DNA, 242 bp, Homo Sapiens
  kidney
  sig_peptide 99..182: Von Heijne matrix
  score 10.00
  seq LWLSLLVPSCLCA/SP
  misc_feature 140: n=a, g, c or t
  unsure -19: position -19 of amino acid sequence
  unsure -18: Xaa = Ala,Asp
  position -18 of amino acid sequence
  unsure -15: Xaa = Asp,Gly,Val; position -15 of amino acid sequence; Xaa = Ala,Ser
accactgtgcccagccattgtctatacagtttgaataacacactgaaaaaacagatcagtgcatatcttccacaattaacaatgcatttgtttagagcatgttgctgcattgggtgcgctctcaggmtgdcagcgackcnaagctttggttgagtttgctagtgccaagttgtttatgtgcctccccttggccccttccttccctgccactccttcttcctcccagcttgctgagcttgctg

SEQ ID NO: 1342 - DNA, 289 bp, Homo Sapiens
  kidney
  sig_peptide 122..223: Von Heijne matrix
  score 9.60
  unsure 16: seq LLLFSLLVSPPTC/KV; position 16 of amino acid sequence; Xaa = His,Leu,Pro
aaaaactctttcttcggctcgcgagctgagaggagcaggtagaggggcagaggcgggactgtcgtctgggggagccgcccaggaggctcctcaggccgaccccagaccctggctggccaggatgaagtatctccggcaccggcggcccaatgccaccctcattctggccatcggcgctttcaccctcctcctcttcagtctgctagtgtcaccacccacctgcaaggtccaggagcagccaccggcgatccccgaggccctggcctggchcactccacctacccgatgg

SEQ ID NO: 1343 - DNA, 406 bp, Homo Sapiens
  kidney
  sig_peptide 26..130: Von Heijne matrix
  score 9.50
  unsure 65: seq AMWWLLLWGVLQA/WP
  position 65 of amino acid sequence
  unsure 64: Xaa = Asp,His,Tyr
  position 64 of amino acid sequence
  unsure 3: Xaa =  * ,Cys,Tyr; position 3 of amino acid sequence; Xaa = Asn,Thr
gcaggtcccagatgtccagttccagatgcctggacccagagtgtgggggaaatatctctggagaagccctcactccaaaggctgtccaggcgcaatgtggtggctgcttctctggggagtcctccaggcttggccaamcccggggctccgtcctcttggcccaagagctaccccagcagctgacatcccccgggtacccagagccgtatggcaaaggccaagagagcagcacggacatcaaggctccagagggctttgctgtgaggctcgtcttccaggacttcgacctggagccgtcccaggactgtgcaggggactctrwbacaatctcattcgtcggttcggatccaagccagttctgtggtcagcaaggctcccctctgggcaggccccctggtcagaggga

SEQ ID NO: 1344 - DNA, 274 bp, Homo Sapiens
  Dystrophic muscle
  sig_peptide 62..172: Von Heijne matrix
  score 9.20
  unsure 27: seq LLAVLLASWRLWA/IK; position 27 of amino acid sequence; Xaa = Ser,Thr
aactggtgcggccgagtgacagttgaccggttttaaccaagtgactggttctagccacgttatgtgcggcccagccatgttccctgccggtcctccgtggcccagagtccgagtcgtgcaggtgctgtgggccctgctggcagtgctcctggcgtcgtggaggctgtgggcgatcaaggatttccaggaatgcacctggcaggttgtcctgaacgagtttaagagggtaggcgagagtggtgtgagcgacasttctttgagcaagagcccgggg

SEQ ID NO: 1345 - DNA, 259 bp, Homo Sapiens
  Muscle
  sig_peptide 71..235: Von Heijne matrix
  score 9.20
  unsure -39: seq SLLLLSTALNILA/CQ; position -39 of amino acid sequence; Xaa = Pro,Thr
acatatctttgcaattgtgaacattcaatcattttcaacacacgttcatggttaatatttctaggaaactatgcatagaagaaaacttcctttaaccaataaaaggcaacttcaaaaamcattgagtaaattcatattcagtgatgaattgtttagaaatattctctttagtttaagaacattaaggatgatactatcactacttctgttgagcactgcattgaatatcttagcctgccaaataaatgaagaactgggg

SEQ ID NO: 1346 - DNA, 250 bp, Homo Sapiens
  Heart
  sig_peptide 182..232: Von Heijne matrix
  score 8.30
  unsure 5: seq VSALLMAWFGVLS/CV
  position 5 of amino acid sequence
  unsure 6: Xaa = Asp,Glu; position 6 of amino acid sequence; Xaa = Leu,Met,Pro,Ser,Thr
aaaacgccgggagctgcgagtgtccagctgcggagacccgtgataattcgttaactaattcaacaaacgggacccttctgtgtgccagaaaccgcaagcagttgctaacccagtgggacaggcggattggaagagcgggaaggtcctggcccagagcagtgtgacacttccctctgtgaccatgaaactctgggtgtctgcattgctgatggcctggtttggtgtcctgagctgtgtgcaggccgadhyg

SEQ ID NO: 1347 - DNA, 198 bp, Homo Sapiens
  kidney
  sig_peptide 49..105: Von Heijne matrix; score 8.10; seq LCLVCLLVHTAFR/VV
aagagcctgtgctactggaaggtggcgtgccctcctctggctggtaccatgcagctcccactggccctgtgtctcgtctgcctgctggtacacacagccttccgtgtagtggagggccaggggtggcaggcgttcaagaatgatgccacggaaatcatccccgagctcggagagtaccccgagcctccaccggaacgg

SEQ ID NO: 1348 - DNA, 206 bp, Homo Sapiens
  Muscle
  sig_peptide 99..191: Von Heijne matrix
  score 8.00
  seq ILLCSVAVXLSPS/EP
  misc_feature 116: n=a, g, c or t
  unsure -26: position -26 of amino acid sequence
  unsure -25: Xaa = His,Gln
  position -25 of amino acid sequence
  unsure -5: Xaa = Asp,Tyr; position -5 of amino acid sequence; Xaa =  * ,Cys,Ser
catagggtttcgaaaattatccacactttctatggtaatagaatctgatatggttcactcttggtgttgtacattctgtgggtctgggtaaatgtataatgttatgtatccaccankataggatcatacaggacagtttcattgccctaaaaattctcttatgttctgtcgctgtatsmctgtctccctccgagcccctggcgccg

SEQ ID NO: 1349 - DNA, 220 bp, Homo Sapiens
  kidney
  sig_peptide 8..121: Von Heijne matrix
  score 7.90
  unsure 15: seq LPFLSLFWPWAPG/AV; position 15 of amino acid sequence; Xaa =  * ,Ala,Gly,Ser
aaggagcatgggtggtttttttccccctaccgaggtccgtgaggtgtgtgctaaccaaggggcggctcacaaccgtgacagactgccattcctgagtctcttctggccatgggcccccggagccgtgagcgtcgggcaggcgcggtacagaacaccaacgacaksagcgccctcagcaagcgttccctggccgcgcgcgggtacgtgcaggacccctacg

SEQ ID NO: 1350 - DNA, 131 bp, Homo Sapiens
  Heart
  sig_peptide 21..110: Von Heijne matrix; score 7.90; seq HLWILLLFSFCWM/SR
acttccctattattcctgaaatgaaattattttacaaccagctcgtttcagaaacaaaacatgattttgcacatttgtggattttgttgttattctcattttgttggatgtctagaagctttttttttttt

SEQ ID NO: 1351 - DNA, 179 bp, Homo Sapiens
  Dystrophic muscle
  sig_peptide 111..170: Von Heijne matrix; score 7.90; seq LLFFHILFHSCFS/HL
acctttaagattacctgtataataaatgtgtgcagacaccatccaaaaaggtgtaaaaaattgcaaaggaaaaataaatactggccaacacagtgttcttaaaagtacccatgcctagtgagtcccctcccttgctgttctttcacattctgttccatagctgtttctcccacctcttg

SEQ ID NO: 1352 - DNA, 362 bp, Homo Sapiens
  kidney
  sig_peptide 18..221: Von Heijne matrix; score 7.90; seq LLCSALAWQQSLS/GK
ataaacaggaaagcactatgtcttcaatgtggtctgaatatacaattggtggggtgaagatttactttccttataaagcttacccgtcacagcttgctatgatgaattctattctcagaggattaaacagcaagcaacattgtttgttggagagtcccacaggaagtggaaaaagcttagccttactttgttctgctttagcatggcaacaatctcttagtgggaaaccagcagatgagggcgtaagtgaaaaagctgaagtacaattgtcatgttgttgtgcatgccattcaaaggattttacaaacaatgacatgaaccaaggaacttcacgtcatttcaactatccaagcacaccacgg

SEQ ID NO: 1353 - DNA, 129 bp, Homo Sapiens
  kidney
  sig_peptide 19..102: Von Heijne matrix; score 7.80; seq FVRFLGFVSCLQS/DP
tagctattttcagcgcttatggctctgttcttggagttatttctaaattcttattctcttttgtttgtaaggtttcttggctttgtttcctgtttgcagtctgatcccatttgctcttttttttttttt

SEQ ID NO: 1354 - DNA, 329 bp, Homo Sapiens
  kidney
  sig_peptide 114..185: Von Heijne matrix
  score 7.80
  unsure 12: seq LMAGSSLSAGVSG/ED; position 12 of amino acid sequence; Xaa = Ala,Pro
atacttcaaatcttgaattaaatgaagaaatttattttactgattctcttgaaataaagagaaatgaaaattttccaaaggattatgtgaaattttcagatgaagaagaatttatgaatgaagatgagaaggaaatgaaggaaattctaatggcaggaagtagtttatcagctggagttagtggggaagataaaaccgagatattgaatcccactccascgatggccaaatctctgaccatagactgtctggaattggcattaccccctgaactggcttttcaacttaatgaattatttggtcctgttggtattgattcagggtctcta

SEQ ID NO: 1355 - DNA, 247 bp, Homo Sapiens
  Heart
  sig_peptide 167..229: Von Heijne matrix
  score 7.80
  seq IIPLIXXLSLCLC/LW
  misc_feature 206..207,211: n=a, g, c or t
  unsure -8: position -8 of amino acid sequence
  unsure -7: Xaa = Ala,Cys,Asp,Phe,Gly,His,Ile,Leu,Asn,Pro,Arg,Ser,Thr,Val,Tyr; position -7 of amino acid sequence; Xaa = Phe,Leu
ctatacgtgataagtgaataaaatgtgtcagagtgtactacttagaattttcatagattgtaaagattttctatatatttatttgaattggtaattggttatgagcagtttggtgtagctgtttttaattgtacaacaattaagatatcacctatattctcgaagaatgggatcattccttctaggagggattatccctttaatanntttnctttctctttgtctttgtttatggtggagaataatt

SEQ ID NO: 1356 - DNA, 399 bp, Homo Sapiens
  kidney
  sig_peptide 277..369: Von Heijne matrix
  score 7.80
  unsure 5: seq VCLLCSGCSCAWS/VG; position 5 of amino acid sequence; Xaa = Leu,Trp
acgagtgttacagaggagatctggtttctggaggtctccaggatggggctgtagcctaaaaggaagactatgtgaggcagcaggcaagcagcagcaagtggaaaggcttggagatgtggaggacgttatatggtactcagagagcagcagtacatggatggcaagtgtggcgttgtgctgccacccacttccccatgccaaaagcatataactgctaatcagttaccgcattttttgctgccgaattcgtaagcagccccaagagttctcaacaggatgcttcaggtggccactactaattatttggagttggcacgtgaggttaaacctgtttgtcttctttgtagtgggtgttcctgtgcctggagcgtaggatgtgtgtkggagtcggagtcagaa

SEQ ID NO: 1357 - DNA, 240 bp, Homo Sapiens
  kidney
  sig_peptide 175..228: Von Heijne matrix; score 7.70; seq PFFLALCFPKSTS/QP
attactttgtctagatcaggagatgctagtatattcttagcactaagacccctctgaaatcttgtccaacatttagccacccagragttgtkctttactacacctttgagggttatgccctgtacatgtgcagcttaggggttcaaggacaatctctttacacatttttgggttatgttctgtctagctcctttctttttagcactctgcttcccaaaatctacctcacagccccaaagg

SEQ ID NO: 1358 - DNA, 451 bp, Homo Sapiens
  kidney
  sig_peptide 236..331: Von Heijne matrix
  score 7.50
  misc_feature 240..335: seq QCLLCCISPPVFC/EG; blastn; identity 95; region 1..96; id AA270737; est
tcctctttgctgttttcatcaagatagtagagcacatcttcttctcacagactacaactatgtggttcagcacgaggcagtagaggaaagtgcctcgactgtgggaggcttggscaaratccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaaggtaactggttatcttacttttatgtgcttcctggatttgtgtgtgaattacataaactgggtatttcttgtttaatcccccttttctctgtctcccctttggcagcctggatggtg

SEQ ID NO: 1359 - DNA, 263 bp, Homo Sapiens
  kidney
  sig_peptide 114..182: Von Heijne matrix; score 7.30; seq SSCLLGLLHLSSQ/FS
atggagcagaggtccagctgtggtgaggattggcacagtcgtgcttgtgggactcctccttggtccaactctaatgctcaacctacaccatcacccctgtgcttgctcctctaatgcctaagcactgtcattcctttatcactagtagttgcctgttgggtttgctccatttgtcctcacagtttagctgccctggaaggaaactccaccctgctcagagacacactgaggctgagacccaagggaggcccctctctgacagg

SEQ ID NO: 1360 - DNA, 351 bp, Homo Sapiens
  Dystrophic muscle
  sig_peptide 166..222: Von Heijne matrix
  score 7.20
  unsure -14,-11: seq FIXFPFLFPFSFS/QT; position -14, -11 of amino acid sequence; Xaa = Phe,Ser
atctctccttttttcctgtaactgtgctggttttgttttggtcttcctctcatacccgtttctgcatttcatcttttctttctattgtgacttcatttcattttttttttaaccttatcttttgtttctcttgtttatcccatcctttttgataaaatccatcgcatgtgtcttcttttttyctttatttyctttcctttccttttycctttttctttctcccaaactttttccttttcacagcattggaacacgggaggtagtcacccagaagaacttgagcggcctggtgcccatccgagacttaaggctagaccccagcctcctctgttccatccctttattagctct

SEQ ID NO: 1361 - DNA, 227 bp, Homo Sapiens
  Dystrophic muscle
  sig_peptide 30..104: Von Heijne matrix
  score 7.10
  unsure -20: seq LLVASGXAEGVSA/QS
  position -20 of amino acid sequence
  unsure -15: Xaa = Ile,Leu
  position -15 of amino acid sequence
  unsure -7: Xaa = Ala,Asp,Val
  position -7 of amino acid sequence
  unsure 5: Xaa = Ala,Asp
  position 5 of amino acid sequence
  unsure 13: Xaa = His,Gln
  position 13 of amino acid sequence
  unsure 20: Xaa = Ala,Gly
  position 20 of amino acid sequence
  unsure 33: Xaa = Ile,Thr; position 33 of amino acid sequence; Xaa = Asp,Glu
acgcgcagacccagcgccgagcccgagccatggcgtccgagcggmtccctaayaggcccghctgtctgctcgtrgccagcggcgmcgccgarggtgtgtcggcccagtccttcctccastgtttcacgatggccagcaccgscttcaacctgcaggtggccayccctggkgggaaagccatggaatttgtsgatgtgactgasagcaatgcacgctgggtgcaagac

SEQ ID NO: 1362 - DNA, 327 bp, Homo Sapiens
  kidney
  sig_peptide 160..234: Von Heijne matrix; score 7.10; seq LAFQLVFLRATSG/SC
aatttcaagttgtcataaaagttcagacaaccatcactggacctacagattgagtgattattatagtggggatgtccttgggttagtaagcctaaaggaagtaatttctgttaaaggagatgttagtggccatttgcatcttaatgtcaatcttatcagatgttcccagactacaaactgggtgggtcatatctcttagcatttcaactggtatttctcagagcaactagtggctcatgttccaaatatagaaggcatttgcataacatcaatgttagacctgggcttgttagactcttgggctcatgtatacaaaagcaacctggg

SEQ ID NO: 1363 - DNA, 370 bp, Homo Sapiens
  kidney
  sig_peptide 44..118: Von Heijne matrix
  score 7.10
  unsure -10: seq LLLXLXLLLIALE/IM
  position -10 of amino acid sequence
  unsure -8: Xaa = Cys,Phe,Tyr; position -8 of amino acid sequence; Xaa = Leu,Gln
aaatgtgtacacgcccagcttcctgcctgttactctccacagtatgcgaagaatatccctgacttctagccctgtgcgccttcttttgtdtctgcwgttrctactaatagccttggagatcatggttggtggtcactctctttgcttcaacttcactataaaatcattgtccagacctggacagccctggtgtgaagcgcatgtcttcttgaataaaaatcttttccttcagtacaacagtgacaacaacatggtcaaacctctgggcctcctggggaagaaggtatatgccaccagcacttggggagaattgacccaaacgctgggagaagtggggcgagacctcaggatgctcctttgtgacatcaaa

SEQ ID NO: 1364 - DNA, 246 bp, Homo Sapiens
  kidney
  sig_peptide 193..234: Von Heijne matrix
  score 7.00
  unsure -6: seq TFLLLLFXNAGRS/LR; position -6 of amino acid sequence; Xaa = Phe,Val
aaaatatttcatattagggagagctctgtgctgccctttcccaaagctttggttatttgatgggaggggaagtcttctcgaacctatgtcmgaatatkccgctttgraagaggagggtttttcttgaggctagttttgtacctgctgtwtcttttagaaatgattgctttatggatttaaaaggtgacccaaatgacttttttattattattatttkttaatgctgggaggagtttgcgtatgtgt

SEQ ID NO: 1365 - DNA, 328 bp, Homo Sapiens
  Dystrophic muscle
  sig_peptide 215..292: Von Heijne matrix; score 7.00; seq EMFLVLLVTGVHS/NK
aaaaagtactgagaggttgatgggactgttcgattagctcctctgagaagaagagaaaaggttcttggacctctccctgtttcttccttagaataatttggatgggatttgtgatgcagaaaagcctaagggaaaaagaatattcattctgtgtggtgaaaattttttgaaaaaaaaattgccttcttcaaacaagggtgtcattctgatatttatgaggactgttgttctcactatgaaggcatctgttattgaaatgttccttgttttgctggtgactggagtacattcaaacaaagaaacggcaaagaagattaaaaggcccggg

SEQ ID NO: 1366 - DNA, 281 bp, Homo Sapiens
  kidney
  sig_peptide 150..269: Von Heijne matrix; score 6.90; seq ISLLFIFFSIANS/SP
attctttccttctcatatctacaattgctcctttctagttcagttccctagtacagctggagtgattattkkskkttaaaaaatgcaagcataaaaaagaaataaacaaatagttaaatcatgttattcttttgtttacactgtaatgaatgtcttccccattgcttgtagaacaaagttctacaaagtctcccaaaagctggtcctggtcctttctagctttctcttgcataagtcttctttttatttttttcagcattgcaaattcttccccctgcggg

SEQ ID NO: 1367 - DNA, 179 bp, Homo Sapiens
  kidney
  sig_peptide 96..170: Von Heijne matrix; score 6.90; seq IPLLLLFFHLSFL/NS
agaacaaagtttagaatgatatgtttatgcctgtgaacatttatcttgttagattatgctcactaagccattggggtgtttggggaatttgatcaatgtatcttttctgtctcttttcagtttcgaaaactatccctctgctgctgcttttcttccacttgtcttttctcaatagcttg

SEQ ID NO: 1368 - DNA, 298 bp, Homo Sapiens
  kidney
  sig_peptide 170..217: Von Heijne matrix; score 6.90; seq CLLILKFLSPAET/SI
acagagttcacttctaggatattccttcccaatcttcacagtcacctcatagtcactatgaggattacatgagtkaatatttgtaaaaagcgttcaggagagtgcttgcttcacatcaaatactatatatacttgttaaataaatagatctcattcaccccacgaaacaatgatcgtttgtctcctgattctcaagtttttgtctccagcagagacbtctattctgagctccatagctacatatggggctttttatttcatagttccactggaggtttcacaaatccttcaaactcag

SEQ ID NO: 1369 - DNA, 275 bp, Homo Sapiens
  kidney
  sig_peptide 180..254: Von Heijne matrix; score 6.70; seq LILCFLFILHTHT/HT
acaaactggttaccctgccacatgtatacccccttctccccattctcacttcctcgttagacgaaatgatcatccagtgaagccatagattatattggccatctaatatcaaaccatattggtctcatttgaaaatctttcatgatgctttgtggtattcacagtgaagtttagattccatggataagagcatcaagtcctctataatctggtctctgattctctgttttctttttatcctgcacacacacacacacacacacacacacacacac

SEQ ID NO: 1370 - DNA, 405 bp, Homo Sapiens
  kidney
  sig_peptide 283..390: Von Heijne matrix
  score 6.70
  unsure -5: seq IFDLLLLLXXSNQ/LP
  position -5 of amino acid sequence
  unsure -4: Xaa = Asp,Glu,Lys,Asn; position -4 of amino acid sequence; Xaa = Ile,Leu
acagacctctttgaaaatctaatgagagccatagacttcaccctaaaaaaatatatatgcataaaaagtttaaatatagtttggagagtaacgcaccttcccctaaagcaattcctaaacctcatttaaaggatctatattctatagttcagttctgcatttttaatgtcttctatattgtctcatgctagaatagtcattatatcttcatatgtaatatttaaagtgtgaattatcatctaacacttcctgtcttctgtcccccaaatctatacttctcccatgttctttattttcattaatggctttacwctccttctaatgaccctagccatgaaacccaggcatcctatttttgacctcttgctattgctkrabhtatctaatcaattgccagttacgggg

SEQ ID NO: 1371 - DNA, 215 bp, Homo Sapiens
  kidney
  sig_peptide 3..182: Von Heijne matrix; score 6.70; seq LWPFLTWINPALS/IC
acatgtgccctagtctggaagaggctcccagtgtcaaggggactctgccctgctcaggacaacagcagcctttcccgtttggagcctcaaacatcccactactcctgggcaggagcagaaaggtggctcgaggtgcaccggtcctgtggccatttctcacttggataaaccctgcactgtccatctgtgaccccttaggatcctgcggatggcag

SEQ ID NO: 1372 - DNA, 400 bp, Homo Sapiens
  kidney
  sig_peptide 287..337: Von Heijne matrix; score 6.60; seq LLSALWFCHPCCL/CC
aagctccaaggcaggaagagaattgggcatcgggtacgaacctggcagctcaggagtcggggctccactcaccccacacaaaaagatgaaaaaagcgcawagagctcaatgcattgattggtttggctggggacagccggagaaagaagcccaagaaaggcccaagcagtcaccgcctgcttcgcactgagcctcccgactcatactctgagtccagctccgaagaggaagaggaattcggtgtggttggaaatcgctctcgctttgccaagggagactatttacgatgctgcaagatctgttatccgctctgtggttttgtcatccttgctgcctgtgttgtggcctgtgttggcttggtgtggatgcaggttgctctcaaggaggatctggatgcccg

SEQ ID NO: 1373 - DNA, 340 bp, Homo Sapiens
  kidney
  sig_peptide 167..223: Von Heijne matrix; score 6.60; seq LLSLAAYLSGPHQ/EP
aaaatgtcctccacagctttgcccagtgggacacatggctcctgacatacgtaacccaggatgggatgccttgttggagtctctcagatatggagcaaaatgggccatgtgcagtcaagacgccatctamcctgggcagcttgcctaagcctcgagggacctgccaatgatggatctgagacctcttctgtccctggctgcctatctgtctggtcctcatcaagaacccagtgttcccacccgagatggagacgtgaataatcttcctaagcctaatcctgccagaagcgtgaagcaagggggaathtggaaggcggaacaggaaagagtggaagtggag

SEQ ID NO: 1374 - DNA, 245 bp, Homo Sapiens
  Heart
  sig_peptide 147..203: Von Heijne matrix; score 6.60; seq LLPGLPLVRTSFS/HF
agcggtcagaggatgccctcttcgccctgtgagcagctctgtggtttgcctccccagatggcgggtccccgcttgcaccccgtggacaccgggcactggccactcctacatccccagctccacacggcctgcacacctgtgtttccatggaaatgccaccgtgtctgctcccaggcctcccactagtcaggaccagcttcagccacttcttttctctgagtggtgggacaactacagccagaggg

SEQ ID NO: 1375 - DNA, 192 bp, Homo Sapiens
  Muscle
  sig_peptide 19..93: Von Heijne matrix
  score 6.50
  unsure -2,6: seq GLAMLHVTRGVXG/SR
  position -2, 6 of amino acid sequence
  unsure 7: Xaa =  * ,Trp
  position 7 of amino acid sequence
  unsure 8,22: Xaa = Pro,Ser
  position 8, 22 of amino acid sequence
  unsure 15: Xaa = Leu,Met
  position 15 of amino acid sequence
  unsure 28: Xaa = Pro,Thr
  position 28 of amino acid sequence
  unsure 31: Xaa = Asp,Glu; position 31 of amino acid sequence; Xaa = Lys,Asn
acatgcgcaggaggctcaatgacagtcgagctttggctaaggctccggggaaagggtctagccatgctgcatgtgacccggggggtctrggggtccagggtccgagtatrgycamtgttgcccgcgctcctcgggmcccccmgggccctctcatcgmtggcagccaaaatgggggaktatcgcaasatgtgg

SEQ ID NO: 1376 - DNA, 126 bp, Homo Sapiens
  Dystrophic muscle
  sig_peptide 7..78: Von Heijne matrix; score 6.40; seq LLILLCSSPPDRV/SY
acaaacatgtctatagaagattttgtgaatagaagcatacttctgatcttgctctgttcttccccacctgatagggtcagctacagagccaaggttttacactcattgcttcaattgcccgcccag

SEQ ID NO: 1377 - DNA, 184 bp, Homo Sapiens
  Muscle
  sig_peptide 32..91: Von Heijne matrix
  score 6.40
  unsure 12: seq FALLFLFLVPVPG/HG; position 12 of amino acid sequence; Xaa =  * ,Tyr
aagtctcagcgtggggtgaagcctagcagctatgaggatccattatcttctgtttgctttgctcttcctgtttttggtgcctgttccaggtcatggaggaatcataaacacattacagaaatattawttgcagagtcagaggcggccggtgtgctgtgctcagctgccttccaaaggagaaagg

SEQ ID NO: 1378 - DNA, 375 bp, Homo Sapiens
  kidney
  sig_peptide 217..255: Von Heijne matrix
  score 6.40
  seq MCLLTALVTQVIS/LR
  misc_feature 307: n=a, g, c or t
  unsure 18: position 18 of amino acid sequence; Xaa = Cys,Gly,Arg,Ser
aatgccagtgtcagcttctctccgaaaactgggtaatacgaaatggtctttattggttgtgaacactcgagctgagaaacattttaggatctttgtgtcttttgtgatgattttgtttctgraagrwggaaasctgtctaaaaatattcaagtgtgcaaccaaggatttagatgaagccagcaaacaaaggaatcatgtaatcaggacctgagcgaatgtgcttactcacggcgttagttacacaggtgatttccttaagaaaaaatgcagagagaacttgtttatgcaagaggagatggccctggngcccctcgccccggatctactgctcatccaccccatgcgattccaaattccccaccgtctactccagt

SEQ ID NO: 1379 - DNA, 156 bp, Homo Sapiens
  Muscle
  sig_peptide 76..129: Von Heijne matrix; score 6.30; seq GLALVAGTPPSRS/CP
atctggcgcgtggtcttgcatttcctacttggtcctgttcgtggcgccgcgcctccgggtgttggggagtccgggatgatggggaatccggggctcgccctagtcgcggggacaccgccttccaggagctgtccccaggcaaactcacagacgcgg

SEQ ID NO: 1380 - DNA, 458 bp, Homo Sapiens
  kidney
  sig_peptide 186..299: Von Heijne matrix
  score 6.30
  seq PCVSLLWAPRXFA/SS
  misc_feature 332: n=a, g, c or t
  unsure -3: position -3 of amino acid sequence
  unsure 11: Xaa = Ala,Gly
  position 11 of amino acid sequence
  unsure 12: Xaa = His,Gln; position 12 of amino acid sequence; Xaa = Cys,Gly
ataacccatatagtagttaagccattgtggtgagggtgtttgaaacccagctatcctatgtaatgctatttccaggggaaaaatattcccaattccaggtaaaagatcagaaacagatatcacctgsawtttgttccaccttcaccccaggcttcagctatacttaggtattactctctggtcccatgaaccatctcatgcctttgactgtgctgcactcagtgcttgaaatgctccgcacaccccgcacacctccctggccctgtgtatcccttctatgggcgcccagagsatttgcttcctcttgctctcaagcatttaccactctgcankgcaattgcttgcttactaatccatctcccacactagattgtgacctccctgagggctcagaaatattaaattcttctctgtatcctcattgcctactcagtgcttggaacacacgacactcaaca

SEQ ID NO: 1381 - DNA, 138 bp, Homo Sapiens
  kidney
  sig_peptide 13..84: Von Heijne matrix
  score 6.30
  unsure -10: seq SLLXLRASQLSEG/DT
  position -10 of amino acid sequence
  unsure 3: Xaa = Cys,Gly
  position 3 of amino acid sequence
  unsure 4: Xaa =  * ,Trp
  position 4 of amino acid sequence
  unsure 5: Xaa = Leu,Met,Val
  position 5 of amino acid sequence
  unsure 6: Xaa = Lys,Asn
  position 6 of amino acid sequence
  unsure 9: Xaa =  * ,Ser
  position 9 of amino acid sequence
  unsure 11: Xaa = Cys,Asp,Gly,His,Arg,Tyr; position 11 of amino acid sequence; Xaa = Met,Val
attattatttttatgggacatgttgtgtttggggatataaaaaatagtttattakgtttaagggcttcgcagcttagtgagggagacacatgrvtgaamtvatgtccabrtatgrtgagaggtaaacacatatcctat

SEQ ID NO: 1382 - DNA, 341 bp, Homo Sapiens
  Heart
  sig_peptide 48..290: Von Heijne matrix
  score 6.30
  unsure -8: seq FLSLLXSVSETPG/SL
  position -8 of amino acid sequence
  unsure 4: Xaa = Cys,Phe,Tyr; position 4 of amino acid sequence; Xaa = Gly,Arg
acttcttccccgggtctccgaagccgctagggaagcgcaagtgggccatggctggcgggaggcgggattacagccagctctttggccgcggccccggtcggctctcgcgagcgcgagcctctgttgtgcgttggtctccccgggcaactgcttgccctgcgccaccgagcctcccggatttaaagcggcaggagctggttagccggatagaatgtgggtgccgagggccggtgggggccaccgcagacttctttctgtccctgctctdcagcgtctctgaaacccctggcagcctgcggrgaaacgatcttttcttcgtctctcagcttatttggggccgg

SEQ ID NO: 1383 - DNA, 272 bp, Homo Sapiens
  kidney
  sig_peptide 207..263: Von Heijne matrix
  score 6.10
  seq LWCFHSFISFSLS/SS
  misc_feature 217: n=a, g, c or t
  unsure -16: position -16 of amino acid sequence; Xaa = His,Leu,Pro,Arg
atcctccatagctatatccatttcctgggacatgggttggcccaagagggaatgagaaggacctgcgattgcacaggaaattctggggcacatttaacgttaaatcattaagcttctgccaataaatccattactgttaattacactgagatggccaacgatctgctgacaatattccttcattgattttcattctcagtgaatcgatgttctggcntggctctctttggtgttttcattctttcatttctttctccctgtcctcatcacgg

SEQ ID NO: 1384 - DNA, 351 bp, Homo Sapiens
  kidney
  sig_peptide 118..225: Von Heijne matrix
  score 6.00
  seq FLLTFFSYSLLHA/SR
  misc_feature 5..7,31,90..93,168: n=a, g, c or t
  unsure -28: position -28 of amino acid sequence
  unsure -20: Xaa = Ile,Arg,Thr
  position -20 of amino acid sequence
  unsure -19: Xaa = Ile,Met,Arg,Ser
  position -19 of amino acid sequence
  unsure 6: Xaa = Asp,His,Tyr
  position 6 of amino acid sequence
  unsure 35: Xaa = Gly,Ser; position 35 of amino acid sequence; Xaa = Asp,Asn
aggcnnncggascsgggctggagagcggcsnccactgcggatctcggaaggaagaaatgatgtaaatcactcatssavactttaaggtcnnnngtgagamggaaggtcaggmagaacatggcctggccaaatgtttttcaaabagggtctctgctgtcccagttcaknbatcatcatgttgtagtgttcctgctcactttcttcagttattcgttgctccatgcttcacgaaaaacatttrgcaatgtcaaagtcagtatctctgagcagtggaccccaagtgcttttaacacgtcagttgagctgcctgtggagatctggagcagcraccatttgttccccagtgcagag

SEQ ID NO: 1385 - DNA, 466 bp, Homo Sapiens
  kidney
  sig_peptide 380..436: Von Heijne matrix
  score 6.00
  unsure 1: seq WILAVGLSLPSSS/XI; position 1 of amino acid sequence; Xaa = Pro,Thr
actctcttctactggaatggtacccttgttgactgactcatgtatagctgcttggcttaatggtagaccagatattcaggtcctctgagacaggcccctgatgacttttgcaactacatctttcamcacagcctgccttgcattttggactctagcaacactgaaatacatgtcatttcccaaggcatgttaagctgtttctattctctaggctctccctttttcctagaatgcccttttcctctaggctaatgtctttctcctttaaattagtcatcttcaacaaaggctaccttgaccttctcttgactttgccacattcctgctgctgccttccttccatggcctttgtcacgctatatggtaattgacaggttccatgatcttgaggaacttatggattttagcagtgggtcttagcttgccatcttcttcamccatcaagtttcatttctctctttactca

SEQ ID NO: 1386 - DNA, 389 bp, Homo Sapiens
  kidney
  sig_peptide 267..371: Von Heijne matrix; score 5.90; seq LCGLLHLWLKVFS/LK
acaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttggtatgttgactgttaatgatgtacgtttctatagaaatgtcaggtccaaccatttcccatttgttcgactatgtggtctgttacatttatggcttaaagtcttttctcttaaacagttaaaaaaa

SEQ ID NO: 1387 - DNA, 272 bp, Homo Sapiens
  kidney
  sig_peptide 111..179: Von Heijne matrix
  score 5.90
  unsure -4: seq LFLNLCILAXPFS/KQ
  position -4 of amino acid sequence
  unsure 23: Xaa =  * ,Cys,Trp; position 23 of amino acid sequence; Xaa = Arg,Ser
attaattttaattttcattgtcaatattttgagcttagaacatttatggtataaaaatttaaactaatcaaagttgtgtgatgatttccgggaattattattgaaagcctatgaatttaaaaccaggtttaccatgtaatttgtttttaaatttatgtatactagcctgvcctttctccaagcaaattattgaactattagaatatgttagttatcatccttgtgtcttagtatatagtgaatacagmaacatcagcattgtatacactctt

SEQ ID NO: 1388 - DNA, 345 bp, Homo Sapiens
  kidney
  sig_peptide 43..162: Von Heijne matrix
  score 5.90
  unsure 26: seq VVLAWGLLNVSMA/GM; position 26 of amino acid sequence; Xaa = Ile,Asn,Ser
accagagagagtggcgcgagctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatadygagcttgcccttgcatctctcttcagccttaatgccttatttgatttttggagatatttcaaatatactgtggcaccaacaagtctggttgttagtcctggacgg

SEQ ID NO: 1389 - DNA, 447 bp, Homo Sapiens
  kidney
  sig_peptide 274..330: Von Heijne matrix
  score 5.90
  unsure -12: seq PXXLLILAHITQS/CP
  position -12 of amino acid sequence
  unsure -11: Xaa =  * ,Cys,Tyr; position -11 of amino acid sequence; Xaa = Met,Val
agtatttgttaaatgctacaagagtgactgggatcataagtgttacgggagtttggcaaagaagcaggaggtagttagtgtaactgttaatgtgattataagactaatacattttgtkggragataacttaccaagtttggtttgtggaaaatttggattgagaaggaaattgtatgtttccgttagaagtagaacaacaacaacaaaatatctcccatcatttgtttggtactatctggcctccccagtgctgcttgggagaatcatgaaacatgatgaatcaaacacatccttrmrtgttgctcatcctggcacatattacacagagttgcccatgggcccatgtaggagcagctccatctgcccttctaatacataggtgggarctgagggggtgctcgtatttgaaactgtttttggttatggtgctcatatttgaaatgctt

SEQ ID NO: 1390 - DNA, 355 bp, Homo Sapiens
  kidney
  sig_peptide 35..94: Von Heijne matrix
  score 5.80
  unsure 86: seq GLVLLLSLAEILF/KI; position 86 of amino acid sequence; Xaa = His,Gln
agtcctagtcagagttttctgtgaaggcaagggcatggggttgccggagagaagaggattggtcctgcttttaagcctagctgaaattcttttcaagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcamcgg

SEQ ID NO: 1391 - DNA, 409 bp, Homo Sapiens
  kidney
  sig_peptide 305..388: Von Heijne matrix; score 5.80; seq LCWALLYNCFSSS/CV
atcagtctgtggagacaggtgagcacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggcctggcagatgtggggtctagaagaggacaggagttatcagggsctccggccattgtgctgggctttgctgtacaattgtttctcaagcagttgtgtycctgtggctttggtg

SEQ ID NO: 1392 - DNA, 401 bp, Homo Sapiens
  kidney
  sig_peptide 129..383: Von Heijne matrix
  score 5.70
  seq ALLASLGIAFSRS/RA
  misc_feature 221..222: n=a, g, c or t
  unsure -55: position -55 of amino acid sequence
  unsure -54: Xaa =  * ,Cys,Trp; position -54 of amino acid sequence; Xaa = Ala,Pro,Ser,Thr
agtagcggacattttgtttctgtcaggctgtccctggccggggttctgtaacgcttgtgtgggccgcaggtggaggtgttgggaaagcgcggaggagatgttgtccccagtgtcccgagacgcgtctgatgctctgcagggacggaagtgcctgcgtcccccgatcgagacgcctgccgctcccggcagctgtccgcgcccacggtcctatggcggactgnncggactccgcgcggggctgtgtggtctttgaggatgtgtttgtatacttctctcgggaagaatgggagcttcttgatgatgctcagagacttttgtaccatgatgtgatgctggagaactttgcacttttagcctcactgggaattgcattttccagatcacgtgcagtcatgaaacta

SEQ ID NO: 1393 - DNA, 261 bp, Homo Sapiens
  kidney
  sig_peptide 61..228: Von Heijne matrix; score 5.70; seq FLCFLNLTSHLSG/LD
atacctaatgataacacagtatctcttcgaatttgtactattgcagaacatttagaaacaatgcttattactcgkttacagtctggtatagattttgcaatccagcttgatgaaagcactgatattggaagctgcacaacacttttagtttatgtcagatatgcgtggcaagatgattttttggaggattttttgtgttttttaaatttaacctcacacctaagtggattagatatttttacagaattagaaaggcgcggg

SEQ ID NO: 1394 - DNA, 382 bp, Homo Sapiens
  kidney
  sig_peptide 191..304: Von Heijne matrix
  score 5.70
  unsure 20: seq LAFLSCLAFLVLD/TQ; position 20 of amino acid sequence; Xaa = Cys,Phe,Ile,Leu,Arg,Ser
aactctgcagggcctccaaggccaggcttcagggctgggactcagtcctgaggcactggggagccatgaggggctgtggcagggaggggcagggtgtggaaagactcccctggggccatggtggagatgtgctgaggtcttctccctgatcgtcttctcctccctgctgaccgacggctaccagaackagatggagtctccgcagctccactgcattctcaacagcaacagcgtggcctgcagctttgccgtgggagccggcttcctggccttcctcagctgcctggccttcctcgtcctggacacacaggagacccgcattgccggcacccgcttcaagacagccttccagctcctggachkcatcctggctgttctctgg

SEQ ID NO: 1395 - DNA, 279 bp, Homo Sapiens
  Muscle
  sig_peptide 190..273: Von Heijne matrix; score 5.70; seq DHLFLLFPRSCSS/LV
ctcttgttaacctgtcttttgctataggagtgtcagacccttatgaggggagaggagagatatcatactttttctacctctacacttttaatatcattaattttctaacaatgcccaaatcttcagtacacctctctctcctgaaccctatacttgtacagcaactttctatgtgacatttcttcttaaatgtctaataagtatatcaaacctagcatgtccccaggaaacactgatcatcttttcctactcttcccccgaagttgttcctccctcgtc

SEQ ID NO: 1396 - DNA, 340 bp, Homo Sapiens
  kidney
  sig_peptide 263..334: Von Heijne matrix
  score 5.60
  unsure -3: seq FFFFLFLLPPXPP/TG; position -3 of amino acid sequence; Xaa = Ala,Thr
atatgtgtaatgtctttattccttagactatggtctccgtggaagattactgatactcccactagtattaataacaatgttaggtaacattactgaatgtttactgagtgccaggtaatgttctaattgctttacatgtattaggctatgtattcctcacatgaaccatatgaaagagatactcttattgttgtcattttagaagtgaagaaactgaggcacagaaaacttaagtaattagtccaattcatacaggtagtatatggtagaactgaagcagttgggccccaggtctttttttttctttctttttcttctgccgccgrctcctccaaccggg

SEQ ID NO: 1397 - DNA, 151 bp, Homo Sapiens
  Heart
  sig_peptide 17..94: Von Heijne matrix; score 5.50; seq LILPALFFFPLHC/TF
aaacaccttctcagtgatgccttacgtcaccatcccatatataatagtgtactcactcattctacctgccctcttttttttccctctccactgtacttttcacggtctaacatactatatatcatgtgtttgttcattatctctacccacg

SEQ ID NO: 1398 - DNA, 327 bp, Homo Sapiens
  kidney
  sig_peptide 247..321: Von Heijne matrix; score 5.50; seq LLLCMDLPHSVLS/NW
aattattttataaaacttctggctggatttaaatactaggcagtattccaagggatgataaaatgtttttacaaacttaattagacccatttttgtaattaaactttattatacatgtgctatgaggattaaactttgcctcataaaagtattctgacaggtgctttgcacagagtaagtccgccaaagtggacgttctcatatgtaattctgagcttactcatactggccaggaaggacgtgcacatgccacctttggcagctgtgatggggagcctgcctctgctcttgtgcatggaccttccacattctgtcctgtccaactgg

SEQ ID NO: 1399 - DNA, 254 bp, Homo Sapiens
  kidney
  sig_peptide 186..248: Von Heijne matrix; score 5.50; seq EFLFLGFPSNSWP/HR
acagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggccccacagg

SEQ ID NO: 1400 - DNA, 165 bp, Homo Sapiens
  Muscle
  sig_peptide 49..102: Von Heijne matrix; score 5.50; seq FLITLFCCCVVVG/FF
acatgtatctgttggctatttgtatatcatctttgcatctttggataaatgttctttgtccattttttaatcactttattttgttgttgtgttgtagtggggttttttggccatgatcattcatttatctcacagttcattcttgttacttgggccagggcaggg

SEQ ID NO: 1401 - DNA, 163 bp, Homo Sapiens
  Heart
  sig_peptide 83..157: Von Heijne matrix; score 5.50; seq CLLHLRCLQLYWA/AR
atcagtgtattttttttatagatttaaaatatacctgaaaacttttctaggaagaataattattcatggaaagagcattgtaatggcatgttttggggagaaaagacatgccaagtcttgtttactacatttaagatgtttacaactatactgggctgctcgg

SEQ ID NO: 1402 - DNA, 374 bp, Homo Sapiens
  kidney
  sig_peptide 279..362: Von Heijne matrix; score 5.40; seq PLSLALQSSCCLC/LT
aataaaccttactttaacagaatttaacagatatctctttaaaaaactgctttaatgtttttaccttctatcttctttttctccagctttatcctgacagrgaagttagcactaattaatctattttctcttccccctcttttttcccttgtgtgtgtcttttctgccttcatctaccccagtgaatttgttcagcattttggctcactcatttcttcagctaactacagcttactactacagccaccactactagagccactcctgtctcatcctggatggttgacagagatgaaaacatcttgctaaagcaaatatacagycccctttcactggctctccagtcctcctgctgtctttgcttgacctcctgc

SEQ ID NO: 1403 - DNA, 213 bp, Homo Sapiens
  kidney
  sig_peptide 115..174: Von Heijne matrix; score 5.40; seq VSVSLCVCDCVRG/ST
ataaaatttacagaaaagttgcaaagaagatagaatttctgcttagcttttgccccaatttcccacttgccacccttccctctttgtgtttgtatctttttttttctgagccacatgaaagtaaagccgccttttgtgtctgtgtcactctgtgtgtgtgactgtgtaaggggtagcacacttacatggaacaggttactgcgtgtgggaggg

SEQ ID NO: 1404 - DNA, 367 bp, Homo Sapiens
  kidney
  sig_peptide 68..184: Von Heijne matrix
  score 5.40
  unsure 32: seq ILLTSCFYTLVSS/TF
  position 32 of amino acid sequence
  unsure 46: Xaa =  * ,Lys
  position 46 of amino acid sequence
  unsure 51: Xaa = Leu,Arg; position 51 of amino acid sequence; Xaa = Cys,Gly
atggctaacatattcttttttttttctctgtagtagttttttgaaagaagaaataggctattctagcatgatctcatcctgtggagttaaatacttgttttcacatgcctccttattttttatggtagggagtacaggaagtttaatactcttaacttcttgtttctatacccttgtttcatcaacctttcttcaaaaactctcttctttgctcttgatattatttaccgaaacaagtgtycttatgttaaaaacatttgtagctaattcttgctgtwaattgtggtctcacaattgtattaatttcttcaaaaaggtcckgccttcttattgckgcagcagtctactcttcctggccgtacctagg

SEQ ID NO: 1405 - DNA, 248 bp, Homo Sapiens
  Muscle
  sig_peptide 174..233: Von Heijne matrix; score 5.40; seq SFLCNFLVSLSLS/FL
agaagggggtgaaaggagtaactgctatatttagaaggaggttaaggatagcaattgattttaagggtggggctagggaacttgtctttaaaatcctgcatttgcacagcaagcacagttcgtattgagattttgctatttggaactgtaagggaggtataggatgctgcctaatgggaggtgggathgcagagagttttctatgtaatttcttggtatcactttccctctctttcctccatggccgg

SEQ ID NO: 1406 - DNA, 408 bp, Homo Sapiens
  kidney
  sig_peptide 265..363: Von Heijne matrix; score 5.40; seq LAYFLCCQGVIFG/SL
ctatttctcattgtctgtctggttttccatccccctcacatgtggtgaccagcacctggcccgccacggcagccaggaggcatttgttaagcgaataatcgagacagggaagaggagtggagttggctgctccagactctgcttagttttcctttctcaaagttctccctcctgtgtcctagccggggaattagctaaaatggaattttctttggtgatcaggtatccttctgatgaagagaagaaaggcctaaactcccaggcatggatgcattagaaagaggtagtcttagaaatgagcaggcgttggttatttatgcaggactggcatactttctgtgctgccaaggggtgatttttggaagtctcccctctaatgctggtgctgggcctttgggatggtctagc

SEQ ID NO: 1407 - DNA, 209 bp, Homo Sapiens
  Muscle
  sig_peptide 78..194: Von Heijne matrix; score 5.30; seq SLWFLPLPTHVYT/HT
ttgcttgaacctaactgtcttgtttttgtcttcctgtgagttcaaggacaggagcagtgcttaacacacagtaggtaatggaatatttgttccagcagcctggacactcaaggggagaagccagggctgctgctgcctctctggaaaccctgtcttccctttggtttctgcctctcccaacccacgtgtacacacatacacatgccaac

SEQ ID NO: 1408 - DNA, 387 bp, Homo Sapiens
  Dystrophic muscle
  sig_peptide 283..327: Von Heijne matrix; score 5.30; seq SSMLITILSFIFA/LG
accacagtcactgtcacattattctgttttgtattttatttacagctcttataattatccgaacttacaaatttattttcttgtgttttctccgcctgctcctccacttcattctgtaatactatagttcactataatacttctagttcctaggactggaattatgtgtctggcacatagtagacagtagatgttcattgaatgaatgaatgattcaaatgagatttaaatagcaacagtcctgacagaatggtaaatttccacacttaagatggtctgttaatggtatcatcaatgttgataactattctatcgtttatttttgccttagggtaccacacagcttcttatccagtctcccttcatccactctcctttttcctacac

SEQ ID NO: 1409 - DNA, 405 bp, Homo Sapiens
  kidney
  sig_peptide 316..369: Von Heijne matrix
  score 5.30
  unsure -2: seq MNLVSALASSAXG/QR; position -2 of amino acid sequence; Xaa = Ala,Thr
acagtacttggaggtattctaaaggcagacatactttatctgagcaggtgcttttggcgtggtcctgccaagaaagaaacaatggcttagatgacgtctattctaaggcctcaaggcttgcacccctgccatgctaaatacagatgcgctcctccaccaagagaatcccctctgccctctgccatctcagccccgagccagctcagctgcccatgacctgtgtgcaaagcagggggcgggacaaacagctatcgcctttggccttccctttgctcctgacagcggtctcaaacctggaggagtcaaaggtccaagatgcctttgttcactatgaacctggtgtcagctctagcgtcctcagcarcagggcagcgtggagcagggccagccctctggcacttgtgt

SEQ ID NO: 1410 - DNA, 232 bp, Homo Sapiens
  kidney
  sig_peptide 110..226: Von Heijne matrix; score 5.20; seq LILLLHCSIRVFF/FF
cttgcttgtaaacataagcatgtattattacctaggctttgaatttcaaaatacggtgtaaactactcatggtaatatagatcttgttagacaaacgttcatgtaaaaaatgatctgcaagcattactgtataaagaaaaataacctggattacttgaatagaatggtttacagtgctcagttaaagttgatacttcttctacattgcagtattagggtttttttttttttt

SEQ ID NO: 1411 - DNA, 429 bp, Homo Sapiens
  kidney
  sig_peptide 232..390: Von Heijne matrix; score 5.20; seq SFLLLQLIHEDKA/IQ
aatttgagaagtgccctcctatacttagagaaaaggaatatccatatctctgaagacacagggacacagagagaatctgaacacacagccttggtaggattccttccgtttatcatcattagatcataaccccytttgtcmagtcctatttctccargactgcctccttcttcattaaaccttgcataaaaactcacaaatttaaccatttatttggattcttatttccttatgaaaattcctgtgtggcataaaacgtgctttttaaaatctgaaagtttttctcctgataatttatctgttagtttgccttgtagacctagccaggtaccctcacaggggcaaggaaaatcttttctcctcctacaacttatacatgaggataaagccatccagaatgaagctattttccagccttctctgcagctg

SEQ ID NO: 1412 - DNA, 222 bp, Homo Sapiens
  kidney
  sig_peptide 133..189: Von Heijne matrix
  score 5.20
  unsure -5: seq FGCTFVAFXPAFA/LS; position -5 of amino acid sequence; Xaa = Cys,Gly,Ser
agtctgggggtgacattgcaccgcgcccctcgtggggtcgcgttgccaccccacgcggactccccagctggcgcgcccctcccatttgcctgtcctggtcaggcccccaccccccttcccacctgaccagccatgggggctgcggtgtttttcggctgcactttcgtcgcgttcdgcccggccttcgcgctttchttgatcactgtggctggggaccgtggg

SEQ ID NO: 1413 - DNA, 358 bp, Homo Sapiens
  kidney
  sig_peptide 80..181: Von Heijne matrix
  score 5.20
  seq LWSSCWLAPLADG/ML
  misc_feature 212: n=a, g, c or t
  unsure 8: position 8 of amino acid sequence
  unsure 11: Xaa = Pro,Gln,Arg
  position 11 of amino acid sequence
  unsure 28: Xaa = Gly,Arg,Trp
  position 28 of amino acid sequence
  unsure 36: Xaa =  * ,Trp
  position 36 of amino acid sequence
  unsure 37: Xaa = Ile,Arg,Ser
  position 37 of amino acid sequence
  unsure 55: Xaa = Ile,Leu; position 55 of amino acid sequence; Xaa = His,Arg
aagatgaagaggaggcdgtggcagtggtggaagaagaggcgcggcggcgggggtagggagcctggaaacgcgagcggggatggtaggtggtttggacccgccgggccgccgtcgtttccagaaagggtttgactggaggaacctctggagcagctgttggctggctcctctggctgatggcatgttgaggtacatgggccagcvgcagcgangggcatccaatccagaggggtccactctagaggccaggccaccagcaccatrggccagtgtgtcaccaagtgtaakhmtccctcatcgaccctgggcagcaaaaatggagaccgtgagcccagcaacaagtcrcatagcaggcggg

SEQ ID NO: 1414 - DNA, 178 bp, Homo Sapiens
  kidney
  sig_peptide 110..172: Von Heijne matrix; score 5.10; seq SLLVVSCFYQISG/RW
atagaactactgcggaacctcaaaatcagtagatttggaagtgattcaaagctaaactttttccttggccctccktgtgttctaattgctttgcaagtgtaakactaggatgtccaagatgccagtttttgcttctttgttagttgtcagctgcttttatcaaatttcaggccgctgg

SEQ ID NO: 1415 - DNA, 204 bp, Homo Sapiens
  kidney
  sig_peptide 136..180: Von Heijne matrix
  score 5.10
  seq VTQLLPFSSPDSA/GP
  misc_feature 97,129: n=a, g, c or t
  unsure -14: position -14 of amino acid sequence; Xaa =  * ,Ser
aacaaagagacacagacaggggactgtcagcyggyaccggaggmgcggacaacgagttatcagcaactsaaagcacctgabgggccgcacattccanccccagcccagtcctcgtcctccacgccagcnccaagcatgtsagtaacccaacttctccctttctcctccccagactctgcgggtccttttctgtcccctttctct

SEQ ID NO: 1416 - DNA, 216 bp, Homo Sapiens
  Dystrophic muscle
  sig_peptide 1..102: Von Heijne matrix; score 5.10; seq SFHFLPWALGAMA/SS
atggggaaagcatggcaagagatgagggtggaatggggggcagacaaggggaatgtcagaagcagcttccactttctcccctgggcactgggagccatggcaagttcagagcaggggaaggagaggtccaacttgtgctttaggaagactcctctggctatcacggggagaggaattgccaggagaccagggggaggttggatgggaatgtgggtg

SEQ ID NO: 1417 - DNA, 166 bp, Homo Sapiens
  Dystrophic muscle
  sig_peptide 2..142: Von Heijne matrix; score 5.10; seq VIRLSQFLLKCWP/RT
aatgaaagtgatgatgaggaagaggaagaaaaaggaccagtgtctcccaggaatctgcaggagtctgaagaggaggaagtcccccaggagtcctgggatgaaggttattcgactctctcaattcctcctgaaatgttggcctcgtacaagtcttacagcagctacg

SEQ ID NO: 1418 - DNA, 415 bp, Homo Sapiens
  kidney
  sig_peptide 254..361: Von Heijne matrix
  score 5.00
  seq SFSIXTLLWGLNC/KR
  misc_feature 321: n=a, g, c or t
  unsure -14: position -14 of amino acid sequence
  unsure -9: Xaa =  * ,Cys,Phe,Ile,Lys,Leu,Met,Asn,Arg,Ser,Thr,Trp,Tyr
  position -9 of amino acid sequence
  unsure 12: Xaa =  * ,Cys,Phe,Leu,Trp; position 12 of amino acid sequence; Xaa = Ala,Gly
actgttttagtgttttgaatatcttcttccagagtttgatgtatatgtatcttggaggtatatgtatttctaattatataaatatttgaccctctttgcctartttgttttattcacttcaactttgaccctttatacttctttttaaatttcactttcttatggttgtttttctacttttcctcaatgccctttgtaaaattttcatttgaatctattattctcccttggacgtcttaattccttctctactatgactttttctttcttttgtttctttcctgggttcaagccactcctgtttcattactttctttttwnktccttttctatttkdactctkctttggggcttgaactgtaagaggtcctggaacataaatttgagaattgttgsatcatacagtagtggttac

SEQ ID NO: 1419 - DNA, 205 bp, Homo Sapiens
  kidney
  sig_peptide 11..133: Von Heijne matrix; score 5.00; seq RLLLILSGCLVYG/TA
agaggcaaccatggcgggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagcctcggg

SEQ ID NO: 1420 - DNA, 240 bp, Homo Sapiens
  Muscle
  sig_peptide 58..153: Von Heijne matrix; score 5.00; seq PLLSCSCPPPLLG/EG
acttccacgggacccaccagcttaaatgccggcagccctgggacttctggcctcacaatggttgagatgactggggtgtggcagtgccaagccgaggctgtgaaaggccttccacctttactctcgtgctcgtgccctcccccattgttaggagaagggcatgctcaggccagcccattagcccaggaggaggacaagaaacacacggagcagacacaagccacctcaccaacccagcct

SEQ ID NO: 1421 - DNA, 157 bp, Homo Sapiens
  kidney
  sig_peptide 59..121: Von Heijne matrix
  score 5.00
  unsure 8: seq AGLLPLLLGNAPG/ES; position 8 of amino acid sequence; Xaa = Asp,His
aatttgctcacacccagcaggcagagaaggcagcagcaggcaggaccgccaccctcccatgcaaatcacccccgggagtgcagctgggctcctcccgctcctcctaggcaatgctcctggggagtctgttgggggaagatgcsatccagggtgctgg

SEQ ID NO: 1422 - DNA, 250 bp, Homo Sapiens
  Dystrophic muscle
  sig_peptide 152..202: Von Heijne matrix; score 5.00; seq TWLLLTLQNSVFT/SF
agaattttgctgggaattaatattaaatactcactggaatttatctttaccaactttagtggaattcagcctatctacagctctcctttccactttgtttctcagaaattctcagcaatggtttcatgaaccactgggaggtcatttgcctatgattttgtccacctggctcttacttacccttcaaaactcagtatttacatctttcaggatatctcccaacagaatacaaagtatgctacctcccatg

SEQ ID NO: 1423 - DNA, 206 bp, Homo Sapiens
  Muscle
  sig_peptide 33..128: Von Heijne matrix; score 5.00; seq VCIVLALCHTSRP/MS
aaatctcttctaatcctccttaatgcattttgatggcttttcatagctattggggaaaaagtttacaatcctttaagacgttcatgagagtctgcattgtcttggccctttgccacacatccagacccatgtcttaccatgttcccctggctgctggctccccactcatgcactggtctccttgtagtcctgtgcccttcattggg

SEQ ID NO: 1424 - DNA, 184 bp, Homo Sapiens
  Kidney
  sig_peptide 113..160: Von Heijne matrix; score 4.90; seq RFTLLPLVLHSQS/SC
atttctcgtaaatgatgagatggggttaaatggttttgcagaaatatgtgagaggtaatgtgaaataagttactttaagaaggcctggccctggtaatgtcgttaccagctgatgaagttgcggtttaccttgctgcccctggtgctacattcacaaagcagctgtgtcttttggaaagccggg

SEQ ID NO: 1425 - DNA, 156 bp, Homo Sapiens
  Heart
  sig_peptide 4..93: Von Heijne matrix; score 4.90; seq FIPFLVIYSFVLS/SP
accatgatgatcattctggggtttgctttttgccctggtcactttaggtttaattttattccattcctggtcatttacagttttgttctgtcatctccccatacccatcgagaaccctattctcctgtggcagactttaatgaatgtaaccgcagt

SEQ ID NO: 1426 - DNA, 335 bp, Homo Sapiens
  Heart
  sig_peptide 198..278: Von Heijne matrix
  score 4.90
  unsure 14: seq CLLSYIALGAIHA/KI; position 14 of amino acid sequence; Xaa = Asp,Gly,Asn,Ser
aactttgcctgggtgtcttgcgttctgcacattccggaggaccagcttccccatcagaagtctgactccatggaaaccagatggggcaacggggtggttctagtgcagactgtagctgcagctcctctccacctctagcctgctcatttccagctcagaaattctactaatggcgttttttcttcctgaaaaaggaaatgaacagggtccctgctgattctccaaatatgtgtctaatctgtttactgagttacatagcacttggagccatccatgcaaaaatctgtagaagagcattccaggaagagggaagagcarrtgcaaagacgggcgtg

SEQ ID NO: 1427 - DNA, 323 bp, Homo Sapiens
  kidney
  sig_peptide 195..239: Von Heijne matrix; score 4.80; seq LFLNLPLVIGTIP/LH
aatatgtaaatgtactatacagaattatacataaaagagaaacttttcatgtatgtaagtttaaaaatgaagtaaatgggggtttcaaataacattaraattggttatgagtttttgaaaaggaaatcatacttggcattctaaacttaatatttctttgcaatgtttaggtatatgtggatattcctggagctatggatttatttcttaatttgccacttgtcatcggtaccattcctctacatccatttggtagcagaacctcaagtgtaagcagtcagtgtagcatgaatatgaactggctcagtttatcacttcctgaa

SEQ ID NO: 1428 - DNA, 352 bp, Homo Sapiens
  kidney
  sig_peptide 11..229: Von Heijne matrix
  score 4.80
  unsure -72: seq VIRSTLVLSQCLC/SR
  position -72 of amino acid sequence
  unsure -53: Xaa = Ala,Glu
  position -53 of amino acid sequence
  unsure -51: Xaa = Arg,Ser
  position -51 of amino acid sequence
  unsure -38: Xaa = Leu,Met
  position -38 of amino acid sequence
  unsure -37,3: Xaa = Ile,Met
  position -37, 3 of amino acid sequence
  unsure -30: Xaa = His,Asn
  position -30 of amino acid sequence
  unsure -21: Xaa = Ile,Asn
  position -21 of amino acid sequence
  unsure -16: Xaa = Pro,Ser
  position -16 of amino acid sequence
  unsure 18: Xaa = Ala,Pro
  position 18 of amino acid sequence
  unsure 39: Xaa = Ala,Asp; position 39 of amino acid sequence; Xaa = Lys,Gln
aaaatattaaatggmaaaaaatcacagaaataaaaaatccatacattttccactgtgcaccattccaagtagmatgmtgaaatcttgtactctcccacttcagcgcacctgggacatsmatccttcctttgtccattggawccaagcccgyctacaatccccaccgyctagtcacttagtasccctctcggtgatcagatcgactctcgtgctatcccagtgcttgtgttcaaggmacccttattttagtgcaatgatgaccccaaagtgcaagagtattgmtgctggcaattcaggtatgccaaagagaaactgtaaagtgcttccttcaagtgaaaagatgmaagttcac

SEQ ID NO: 1429 - DNA, 370 bp, Homo Sapiens
  kidney
  sig_peptide 317..358: Von Heijne matrix; score 4.80; seq SFIALVYSSLSFQ/KV
agagcaaagcagacagaaattcctctggttctgtagagctgacaattcattaatgtgaggtagtcaataacaaatatattttatgtcaagtggtgratggdtycdattgaagaaaaatgactcaataagaggagagaaaatgatggtatgtgtatggtgggtaggtgtgcgtgatgctgttttggatagcgaggcctccgattagatgctacgtgagcagggacccaaaagagccatgtgtttcatctacctgggggagaagcctgctggcagatcctgttgaacactcgttacctaaatctcttgcattggctccatgtcatttattgctctagtgtattcttcactatcttttcagaaagtgccaggg

SEQ ID NO: 1430 - DNA, 164 bp, Homo Sapiens
  kidney
  sig_peptide 93..158: Von Heijne matrix
  score 4.70
  unsure -6: seq IVLFLNSXFPIIC/SR; position -6 of amino acid sequence; Xaa = Asp,Ile,Asn,Val
ataatatagatctttaatttctctcagcaatgattatagttcacaatgtggaggatttacatgtctttcattaaatttatccaaagtactttatggtttttgatactttaaaaagtagaattgttctttttttaaattcgrwtttcccaatcatttgcagccgg

SEQ ID NO: 1431 - DNA, 274 bp, Homo Sapiens
  kidney
  sig_peptide 68..244: Von Heijne matrix; score 4.70; seq IFLFSILLMSLRT/FH
aaagcacagatggcagtccattcattgaagatggtttttttcaaggtgagtgttggtcttttgcacaatgcttgagatggaaatgacttggctgagactatgtgatgagtgctccagatggggcatggcatcggcatggggtaggggtggaaagcttcttggagctcaagtagcccttcatcctagaaactgcagcaaagctaagatcttcctgttcagtattttattaatgtctttaagaacttttcactgtaattatttcagaggcaatggg

SEQ ID NO: 1432 - DNA, 400 bp, Homo Sapiens
  kidney
  sig_peptide 104..154: Von Heijne matrix
  score 4.70
  seq MLFFLGALCRESG/VP
  misc_feature 281..282: n=a, g, c or t
  unsure 43: position 43 of amino acid sequence
  unsure 69: Xaa = Ala,Cys,Asp,Phe,Gly,His,Ile,Leu,Asn,Pro,Arg,Ser,Thr,Val,Tyr; position 69 of amino acid sequence; Xaa = Lys,Arg
aacaaaggagggaagggttagagtgaggtactcacccagagaagagctgtcccggcctgggggtcccattcgtcccttctctttcttgccaaagagacggcctatggatgacttgatgctcttcttcttgggggctttgtgcagagaatctggggtgccctcactgggaaagcaggagagaatgagagcatatgctgctgagatgccccctctcctcccaagtccttgtccacccccttctcatcttcccaagccagcttctccctgtccctatcccttgnncctgctgaccttccccgtgggggtcccccatcttccagggacccgcctgcagtgccaaggcctgggtcattctctcaracgggcagagcggggagtgggtggtggggtgtctcctggg

SEQ ID NO: 1433 - DNA, 225 bp, Homo Sapiens
  kidney
  sig_peptide 13..87: Von Heijne matrix; score 4.60; seq LPTLLLLPVGAPG/KK
atcgaatgcagaatggttttgggagccctgaaccttccctcccaggaactccccactctcctgctcctcccagtgggggcacctggraagaaaaaaggcatggaaggcaaaactcccttggacctgtttgctcattttggccctgagccaggggaccactcagatccgctgcctccctctgcaccctctcccactcgggagggggctctgaccccgcccccaggg

SEQ ID NO: 1434 - DNA, 308 bp, Homo Sapiens
  kidney
  sig_peptide 207..263: Von Heijne matrix; score 4.60; seq QTFVSFLSIPVLG/LV
atacacctccattttaaatgtgctgcaatatgaatgaagtgacctgtgtttcatcacttgttcaaatgattcttatccatgtttttgtacttagtaagggccatacgtagtgggattaaatatttgtgcccttgctttgaaaacaaaactgaaagtgaatgacacataagggcagggatttcagaacagatttttcttgaataaaaatgcttgtgtcaaaaattcaaacatttgtctctttcctttccattccagttctaggtctcgttccagatcatattctccagctcataacagagaaagaaacc

SEQ ID NO: 1435 - DNA, 304 bp, Homo Sapiens
  kidney
  sig_peptide 188..280: Von Heijne matrix; score 4.60; seq LLSTGLNILGTQA/FR
atcatagtcactttccaagtttatgacccagagcaatctgaccttggtagcttgtctccctcattaaattctctgacttcataatcagctcacattcccttcctctctttccctctctttttaaatatctgtaaaacattcaaattgatccacgtagatttatcttgcttttaggccacactctgagatgtgtaatccggttgctcacacatttagaggagtccatgagcatcacgccatgctactctccactggtttgaacatcttaggcactcaggcattccgttacgaagatgggcagctg

SEQ ID NO: 1436 - DNA, 410 bp, Homo Sapiens
  kidney
  sig_peptide 126..176: Von Heijne matrix; score 4.60; seq ILLWEACTGRCQA/SL
tattcagttgggggcaagccagccatgatgtggacctttcattgggtagggcaagtccccaaagttggaaaaatggaaagtgggagctgtgaggcacgtgttacacccacactttcctcctacagatgcagtgttggattttgttgtgggaggcatgcacaggtaggtgccaggcctccctactctctccctggcccagaggtggcaggggcaagttagtggcagtggtggctgcaaaatggttggcagcaatctgtgggatttgggctatcaaagaaatgccaagccatggccacagtcttcaagcaggggcaggggaaggtgcactggtgacctggagcctgcaaacctcatttggtgtgaagcagtataagtggggagttgtgtggcatgaagcaaacctgttgctt

SEQ ID NO: 1437 - DNA, 247 bp, Homo Sapiens
  kidney
  sig_peptide 149..223: Von Heijne matrix; score 4.60; seq VLCILGCHGNLCC/EP
attttagaaagtaaggaaataaaactttaattgaacttggaataaactcagttctgagcattccattctactctgcagttgtcatttatagacagctgtggatcataatacctatagactagatatcgttatctacttatttatattaatgacaggatatccctgggcaaacagcatcaccactgtactgtgtattcttggttgtcatgggaacctttgctgtgaaccagcagtgagagcactcggg

SEQ ID NO: 1438 - DNA, 561 bp, Homo Sapiens
  kidney
  sig_peptide 475..546: Von Heijne matrix
  score 4.60
  seq IFTALFLXLHSVA/IN
  misc_feature 495: n=a, g, c or t
  unsure -18: position -18 of amino acid sequence
  unsure -6: Xaa = His,Pro,Gln,Arg; position -6 of amino acid sequence; Xaa = Leu,Met
aatttatggatgcctaccatctaccaggtactgttctagctacaaggaataactaaaaataggtaaacaaaacagatgaaaaacttagaaatttatactgatgttatcagagtaatgtttaatttttcagataattgttatgtctaaattagcatttgatttttcaattaagaatttttaaattatccaatattgcaagcatatatagaaacatggaaaacaacaaaattctcatgcatatacttcaaacacagagctaacagatgttattattttttatttctttcacaacccaactttcgggaaacaaaataggcacagcaaaactgggatctcctcatccccttctcctttcttatataaaagtaatcctgctcttggtacagctatgtatcatactcatccaggttttaatttttcttatataacggaacatatatggtgttattttacggattttaaagctttacataaatggtgtcatgtgatgtwcvntcttatgtgatcatttttactgcactctttttawtgctgcatagtgtggcaataaatgaagagttt

SEQ ID NO: 1439 - DNA, 160 bp, Homo Sapiens
  Dystrophic muscle
  sig_peptide 80..139: Von Heijne matrix; score 4.60; seq LFAIFLMCLKSIG/SV
atgataagggcttattcacattattcattcttgaatgaattttgatagtgtctgtctttcaggaactttgtcctaagtaatgaaatcctttgataaaaagttgtttgcaatatttcttatgtgtttaaagtctataggttctgtggtgatgccccagccg

SEQ ID NO: 1440 - DNA, 338 bp, Homo Sapiens
  kidney
  sig_peptide 36..134: Von Heijne matrix
  score 4.50
  unsure -4: seq LASLFGLDQXAXG/HG
  position -4 of amino acid sequence
  unsure -2: Xaa = Ala,Val
  position -2 of amino acid sequence
  unsure 28: Xaa = Ala,Gly,Pro,Arg
  position 28 of amino acid sequence
  unsure 35: Xaa = Ala,Thr
  position 35 of amino acid sequence
  unsure 54: Xaa = Ala,Gly,Ser,Thr
  position 54 of amino acid sequence
  unsure 56: Xaa = Asp,Asn
  position 56 of amino acid sequence
  unsure 61: Xaa = Gln,Arg; position 61 of amino acid sequence; Xaa = Ala,Gly
attttcctccccgcaacctggtgaaagccaaykcaatgttcggtgcgggggacgaggacgacaccgatttcctctcgccgagcggcggtgccagattggcctcactttttggactggatcaggyagcysstggccatggaaatgaatttttccagtacacagccccaaaacagcctaagaaaggccagggaacggcagcaacaggaaatcaggcarcaccaaaaacagcaccagccrscatgagcactcccacaatactggtcgcaacagcagtccatgcatatcgatacacaratggtcratatgtaaagcaggsraatttggtgctgcagttctgg

SEQ ID NO: 1441 - DNA, 292 bp, Homo Sapiens
  kidney
  sig_peptide 107..190: Von Heijne matrix
  score 4.50
  unsure -3: seq RFLSLSAADGXDX/SX
  position -3 of amino acid sequence
  unsure -1: Xaa = Ser,Thr
  position -1 of amino acid sequence
  unsure 2: Xaa = Ala,Gly; position 2 of amino acid sequence; Xaa = His,Gln
aaagtcagcgctggagtcggctaggcggctggaaacggcggctgccgccggtgactcagggaggcgggaggccgmsggmggagctcttcctgcaggcgtggaraccatggtgctcacgctcggagaaagttggccggtattggtggggaggaggtttctcagtctgtccgcagccgacggcascgatgscagccamgacagctgggacgtggagcgcgtcgccgagtggccctggctctccgggaccattcgagctgtttcccacaccgacgttaccaagaaggatctgaag

SEQ ID NO: 1442 - DNA, 429 bp, Homo Sapiens
  kidney
  sig_peptide 361..411: Von Heijne matrix; score 4.40; seq LTSVFQAMIWSQG/VS
atgaaaacagttttctttgtgatttgtcaattgatgtttaaacagtgtttatccttccaggtagtatgatgatgtatttgttggagacaaartatttgccctagcctttttactaatatttcagatgagattctgtggaggagaagcatctccccaaatgtccttgttttatagtaaataattctaccacgaggatccttatccataaatctatattcatgtttattttgtgctagatacagatcttgcaatattcatgaagctttaagaagagcactttgaatcttaaaagagattctctgagcaggggttggcagtggtgaggtccaggtagttataatagccataagagcagggattatggttattgagctcaccagtgtgtttcaagccatgatctggagtcaaggtgttagtgattcctctaag

SEQ ID NO: 1443 - DNA, 250 bp, Homo Sapiens
  kidney
  sig_peptide 47..196: Von Heijne matrix
  score 4.40
  seq ILFLFYFPAAYYA/SR
  misc_feature 144,187: n=a, g, c or t
  unsure -22: position -22 of amino acid sequence
  unsure -21: Xaa = Asp,Gly,Asn,Ser
  position -21 of amino acid sequence
  unsure -19: Xaa = Asp,His
  position -19 of amino acid sequence
  unsure -18: Xaa = Cys,Phe
  position -18 of amino acid sequence
  unsure -17: Xaa =  * ,Leu,Ser,Trp
  position -17 of amino acid sequence
  unsure -14: Xaa = Ala,Pro; position -14 of amino acid sequence; Xaa = Arg,Ser
atdccgccctggagcaagccggggcctggtcggcarctgggccgccatggagtccacgctgggcgcgggcatcgtgatagccgaggcgctacagaaccagctagcctggctggagaacgtgtggctctggrrtsacctttkctngscgatcccaagkatcctctttctgttctacttccccgcggcntactacgcctcccgccgtgtrggcatcgcggtgctctggatcagcctsatcaccgagtggctc

SEQ ID NO: 1444 - DNA, 288 bp, Homo Sapiens
  Heart
  sig_peptide 196..270: Von Heijne matrix
  score 4.40
  seq VLVGVFLSTFLYC/EC
  misc_feature 3: n=a, g, c or t
atnctgtgttactcatttcctgtctcagatactttggatcccttggttctgatctttcagggggagagggcatgttaagaggagtaagtagatggatgatcttacacaattgaactcttcttacctctggccttgtatgctcttacataggctgtcccctctctacattttcttatttaaggaaaaacacagaacatgattattgtctcagaattaggaacccctactggtgtgctcgtaggtgtctttttgtctacttttctctattgtgaatgtgtaaaggggccg

SEQ ID NO: 1445 - DNA, 190 bp, Homo Sapiens
  kidney
  sig_peptide 80..145: Von Heijne matrix; score 4.40; seq GFLLCPLVCGLRR/WT
agcgtttatggccgcgttaagtctgagtgccgctttgagttgttgaatgaagtgaacttcatttgtcagcgttcggttcatgaactggaatgtaagaggcaccagaggattcctgctctgtcccctggtttgcggcttgcgacgttggacatccccggattgttgtttaatagagaaaactcaccgcggg

SEQ ID NO: 1446 - DNA, 111 bp, Homo Sapiens
  kidney
  sig_peptide 49..105: Von Heijne matrix; score 4.40; seq RGLLLGLAVAAAA/VR
aagatagaggcggcaacctcggaagtgcggacgggtgggcctatatagatgttgaggtgcggaggccgtgggcttttgttgggcctggctgtagccgcagcagcggtaagg

SEQ ID NO: 1447 - DNA, 175 bp, Homo Sapiens
  kidney
  sig_peptide 95..136: Von Heijne matrix; score 4.40; seq ILLMIVFSIFLLL/CN
acccagaggcagaaagtaatattgcttactatgagtctatatatcctggggaatttaagatgccaaagcagctcattcacatacagcgtaagtaatgattctcttaatgattgtattttctatatttctcttattatgtaacttgacagatttttatctcttcaggagcgatggg

SEQ ID NO: 1448 - DNA, 214 bp, Homo Sapiens
  kidney
  sig_peptide 149..190: Von Heijne matrix; score 4.40; seq SLLFIFRSILISC/FS
acaatttgttttataagcctatattaattgggttttgactgaattaattatataaccatttatctcaaaatgaaatgttccataaaatttatttaawagtatatactgyataagtgttaaattatgaaatttagtggtcttatagagaatgtctttattgtttatttttaggtcaattttgatctcctgcttttcaggagactttttttttttt

SEQ ID NO: 1449 - DNA, 164 bp, Homo Sapiens
  Dystrophic muscle
  sig_peptide 27..77: Von Heijne matrix; score 4.30; seq SKVLIQLSQAFWA/SP
acctggtatgaattacaaaactgtaaatgcctttgattagtaaagttttgatacagctaagccaagcattttgggcctcacctgagggtaggaacagttctgggagtaagaggaagcagttggtagctgcagtggagatgcgatactgtaaaaggcagcagggg

SEQ ID NO: 1450 - DNA, 465 bp, Homo Sapiens
  kidney
  sig_peptide 142..228: Von Heijne matrix
  score 4.30
  unsure 61: seq VLLGSTAMATSLT/NV; position 61 of amino acid sequence; Xaa = Glu,Gly
aagttgtaatcccactaagaaccgccagggcgagacgaaagcgacatcgcttccatctttacgaccaagaatcgccttcagccctgtctggtgcatccttggcagaaagtgaggaggraaacacccccattgttctttggcatggacacaagttcagtgggaggattagaattgactgatcagactcctgttttattagggagtacggccatggcaactagtctcacgaatgtaggaaactcatttagtggtccagctaatcctttagtgtctagatctaataagtttcagaactcgtcagtggaagatgatgatgatgttgtttttatcgaacctgtacaacctcccccaccttctgtaccagtggtagctgatcaaagaaccataacatttacatcatcaaaaaatgragaactacaaggaaatgattccaaaattactccttcctcaaaagagttggcatct

SEQ ID NO: 1451 - DNA, 244 bp, Homo Sapiens
  Kidney
  sig_peptide 92..184: Von Heijne matrix; score 4.30; seq ILLLTHVPPWILE/NP
acacacgtcccgcmgtggatactggagaatccttgccacacacgtcctgccgtggacactggagaatccttctcgccacacacttcccaccatggacactggagaatccttctcgccacacacgtcctgccgtggacactggagaatccttctactcacacacgtcccaccgtggatactggagaatccttcttgccacacacgtcccgccgtggacactggagaatccttctcgccacaacgg

SEQ ID NO: 1452 - DNA, 453 bp, Homo Sapiens
  kidney
  sig_peptide 154..246: Von Heijne matrix; score 4.30; seq LVLLSVLKEPVSR/SI
ataggactgctacaaaaaccccatgtttacgaatttgccagtgatattgcccccttcctgtgtcatcccaatttatggatacgttatggtgccgtgggatttatcacagtggtagctcgtcaaataagtacagctgatgtctactgtaaactgatgccttatcttgacccatatattacccaaccaataatacagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacagggaatgacagaggaagaggaagacaaacttctggcactgaaagacttcatgatg

SEQ ID NO: 1453 - DNA, 312 bp, Homo Sapiens
  kidney
  sig_peptide 181..267: Von Heijne matrix; score 4.30; seq VLLGSTAMATSLT/NV
arraaagccgggactggaccgagcggagtkktgcgtgtcgccgaaggggggtkggccgggggaggkgaggttcgttccgcggakccgcagycagaascgkgraccaagaatcgccttcagccctgtctkgtgcatccttggcagaaagtgrkgakgaaaacacccccattgttctttggcatggacacaagttcagtgggaggattagaattgactgatcagactcctgttttattagggagtacggccatggcaactagtctcacgaatgtaggaaactcatttagtggtccagctaatcctttagtgtct

SEQ ID NO: 1454 - DNA, 182 bp, Homo Sapiens
  kidney
  sig_peptide 33..116: Von Heijne matrix
  score 4.20
  unsure -17: seq FGLLDFVVQCCDS/LR
  position -17 of amino acid sequence
  unsure -16: Xaa =  * ,Lys,Arg,Trp
  position -16 of amino acid sequence
  unsure 5: Xaa = Asp,Asn
  position 5 of amino acid sequence
  unsure 6: Xaa = Lys,Arg
  position 6 of amino acid sequence
  unsure 19: Xaa = Arg,Trp; position 19 of amino acid sequence; Xaa =  * ,Trp
attttttatgacatctawttatattgagttgcatgcatgttttgttcaacatagtcacaacaaatwrrrataaccattttgggttgttagattttgttgtgcagtgttgtgattcattaagaaaccatargwggtcatttcagtcatcttacttgaggctaaatcattcatgrcatacatgt

SEQ ID NO: 1455 - DNA, 347 bp, Homo Sapiens
  kidney
  sig_peptide 150..215: Von Heijne matrix
  score 4.20
  unsure 7: seq TAYWLSFMSWAQS/SS; position 7 of amino acid sequence; Xaa = Phe,Ile,Leu
atgtatactgaggttcaggaactgctggagagatgactgggcaccaagaggatgacagtgactcagctggcatcccttagctggttcatggcagagctgagtggccactcctgtctctgaccccagcttcagtgctctttatctcctccatgcctcctcagtcgtgctgctctaagactgcttactggctttccttcatgtcctgggcacagagcagttcttttggtagcagahttgagtccacttccccctgcacagatcactgctcaggacccagagaggagcagctctgctccagcagggttttccattgcatcacacacccaaacggtaggatccaccggtgg

SEQ ID NO: 1456 - DNA, 127 bp, Homo Sapiens
  Dystrophic muscle
  sig_peptide 53..94: Von Heijne matrix; score 4.20; seq SCVFFHFLQGGLG/FG
aactttcttcaaggcggtttgggatttggctccgctggccgctgtgctggtgatgtcctgtgttttctttcactttcttcaaggcggtttgggatttggctccgctggccgctgtgctggtgacagg

SEQ ID NO: 1457 - DNA, 317 bp, Homo Sapiens
  kidney
  sig_peptide 156..215: Von Heijne matrix; score 4.20; seq LILLPIWINMAQI/QQ
aaactcgaacttggtcggggcgcggatcccgagagggaaagtcataacaaccgcacgagggagttcgactggcgaactggaaggccacgcctcctcccgcctgccccctcagccctgtggctgggggcagagctcagactgtcttctgaagattgatgtctatttccttgagctctttaattttgttgccaatttggataaacatggcacaaatccagcagggaggtccagatgaaaaagaaaagactaccgcactgaaagatttattatctaggatagatttggatgaactaatgaaaaaagatgaaccgccaggg

SEQ ID NO: 1458 - DNA, 205 bp, Homo Sapiens
  Heart
  sig_peptide 50..151: Von Heijne matrix; score 4.20; seq SFCNAVVLSPVFQ/EE
aagttatacagaagacttgtaggaaggatggacaaacgttcttaagcccatgacggcccttaacctggtcgctcccttttctgatggagactcaggcagcgtctctctagcttctttctgcaatgctgtagtactctctccagtatttcaggaggaggagcatttgctatttcaaaaacgaaaaacaaaaacctggccacccagg

SEQ ID NO: 1459 - DNA, 270 bp, Homo Sapiens
  Kidney
  sig_peptide 154..204: Von Heijne matrix; score 4.20; seq PVQVLGLLATCQH/AP
aatatgtaaccaaaaataaagtgtttcaatagtttattcctctttcatataatggtctagagagagtgtcattggggcaaagggcaaagatacagaggatctgtttcccttctatcttgtttttctgtaatcacctagagcagtgctactcaaatgtggtccagaccagtgcaggtcttgggacttcttgccacttgtcagcatgctccctctccctcctttaaaggtgagacatgtacagaaattgagagtgtttatctggcccccatg

SEQ ID NO: 1460 - DNA, 208 bp, Homo Sapiens
  Muscle
  sig_peptide 125..196: Von Heijne matrix; score 4.20; seq SLNQILLFLLISC/RT
tactgtggtaagcacttagtaatgcaaagtattgttattctaattatttccaataagaatagtgccttttattggggaaagagtctacttggctgatcacaacaagaggtttatttcttcctccatgaggtaccggttaaggattcaaatcacaacatccctcaatcagatcctgctattcttactgataagttgtaggaccttgagc

SEQ ID NO: 1461 - DNA, 375 bp, Homo Sapiens
  kidney
  sig_peptide 271..345: Von Heijne matrix
  score 4.20
  unsure 5: seq VLLFFCCSPLYSP/LF; position 5 of amino acid sequence; Xaa = His,Gln
atgtaatggaagcaatcattttgaaaagagttaaagttttttggtaagtcaaataaggatcaatgctgctgaaagctgggacaacacacgggccctgaccaaattggggtttctttgtctacctcataccttccaaatcaaaaaataatttccctagtattttaattactcccccaaatcaggaataacttcctcactgtgctgattttggttcttttaaaataaggtggtaatttgaaggtaatagttaaaccagtcatagattattctatgccattcttttcaaatcagcccactcaggtgtcagtcctacttttcttttgttgtagtcctctttattctcctttgtttctgctccavctcatcccccaccag

SEQ ID NO: 1462 - DNA, 376 bp, Homo Sapiens
  kidney
  sig_peptide 32..163: Von Heijne matrix; score 4.10; seq IAVGLTCQHVSHA/IS
gctgcggcccggcccggcgggtaaataacagatgcgggtgaaagatccaactaaagctttacctgagaaagccaaaagaagtaaaaggcctactgtacctcatgatgaagactcttcagatgatattgctgtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccagggatgtggtaaaaactcagaaagccaacattcattgaagcactttaagagttccagaacagagcccctcagg

SEQ ID NO: 1463 - DNA, 152 bp, Homo Sapiens
  Heart
  sig_peptide 9..140: Von Heijne matrix; score 4.10; seq GTYLTSSSPLCQL/QP
actttaatatggtgtccttgggttattatttaatatttgtcctatatctttggctttgtttcatgcaaattagtgaagagaagttaatagaggaacacacaggtacatatttaacctccagttcacccctctgccagctccagcccccaggg

SEQ ID NO: 1464 - DNA, 259 bp, Homo Sapiens
  kidney
  sig_peptide 128..232: Von Heijne matrix
  score 4.10
  unsure -29: seq VLCCLLIATPTFF/LL
  position -29 of amino acid sequence
  unsure -28: Xaa = Ile,Val
  position -28 of amino acid sequence
  unsure -25: Xaa = Ile,Leu,Pro,Thr; position -25 of amino acid sequence; Xaa = Asp,Val
atattattaaactttttattttgaggttagtgtggattgaaatacacttccaacaattaacacaaaggtcccctgtgtcctttacccagttttccacaatggtaacatcttacaaaactggagtacaatgtcactcacatccaggrtamyaatwatggwtacaatcaagatacagaatatttctattacaaaggtcttgtgttgccttcttatagcaacacctactttcttcctactccttccctcatccattccacgg

SEQ ID NO: 1465 - DNA, 217 bp, Homo Sapiens
  kidney
  sig_peptide 137..190: Von Heijne matrix
  score 4.10
  unsure -17: seq AGVVSTSVAAAVA/AV; position -17 of amino acid sequence; Xaa = Asn,Ser
aagcgcaaccggaactagccttctgggggccggcttcctttatctctggcggccttgtagtcgtctccgagactccccacccctccttccctcttgaccccctaggtttgattgccctttccccgaaacaactatcatgarcgccgaggctgccggtgttgtctccacctcggtggccgcggctgttgctgctgtcgctgctcctgctggggccggg

SEQ ID NO: 1466 - DNA, 196 bp, Homo Sapiens
  Muscle
  sig_peptide 101..145: Von Heijne matrix; score 4.00; seq IMSSCLALTYTNS/IS
ttggtatctggagtgttgtagtgtgtttgtatttgcttataaataagtattatagataaagataaacttcataaagagtggatattttggggaaaatttcatgtggataatgtcatcctgtctggcattgacatacacaaattcaatctcacatagtctttgccttgagagagcgtacagtctattcaaagttgac

SEQ ID NO: 1467 - DNA, 214 bp, Homo Sapiens
  kidney
  sig_peptide 65..124: Von Heijne matrix; score 4.00; seq SNALVLVTRGSSS/LP
acagtgtggctcggttgaataggagagctttaactgcattctcttgtgagaatgcagtbgaagaatgccaagaggagtgtacaattcaaatgcgttagtgcttgtaacacgtggttccagttctctccctcttggcttgtatggtataaattgtgtacaggtaattaagttattttatagaggccatctccactgggaaactttgctgccatcg

SEQ ID NO: 1468 - DNA, 353 bp, Homo Sapiens
  kidney
  sig_peptide 210..341: Von Heijne matrix; score 4.00; seq FLLPCVHPFSVIA/VY
aatttatgataggaaatgattgatcaagtgtcacacagctgattatcaggtctcagtctaatatttattccttattggtctctgcttaacttcaagtaggttatagattccttaatggactgatagtttatgtcttatagctttacctttcaggcgcttagtttcatattgggaacatgacaagtgaataataaatacatgatagctctatgattgaaccctgtgagaaaatgaagcattatgatatgaattggtttctgtgtatgtatgagtgtttttttttycatcttttggaaacagaatttctgctcccctgtgtacaccctttctctgtaattgcagtgtatgttttt

SEQ ID NO: 1469 - DNA, 307 bp, Homo Sapiens
  Muscle
  sig_peptide 134..298: Von Heijne matrix
  score 4.00
  unsure -46: seq AALCGISLSQXFP/EP
  position -46 of amino acid sequence
  unsure -3: Xaa = Lys,Arg; position -3 of amino acid sequence; Xaa =  * ,Leu
agcctccgcctttgccttcgcagccgcctccagggcaatttgcatatttctccaaagaaccatccagaacctgagcagcctgtcttcagacagagataggcccacggctgtttcttgaaatctggcgctgggaatggccatgtggaacaggccatgccagargctgcctcagcagcctctggtagctgagcccactgcagagggggagccacacctgcccacgggccgggagctgactgaggccaaccgcttcgcctatgctgccctctgtggcatctccctgtcccagtkatttcctgaaccgggg

SEQ ID NO: 1470 - DNA, 189 bp, Homo Sapiens
  kidney
  sig_peptide 130..180: Von Heijne matrix; score 4.00; seq CLLVSYAVDSAAG/RF
attgtcaaaaagacatcaaactcaacttctgggaagacagatttttaatacacatacttggctaatactcacaaacatatctaaagttttggcaaaattatgagggtgatgggtkggtactaacctggcatggagcaggtgtgtcttttggtttcttatgcagttgactctgctgcagggagattcggg

SEQ ID NO: 1471 - DNA, 364 bp, Homo Sapiens
  kidney
  sig_peptide 20..103: Von Heijne matrix
  score 4.00
  unsure 8: seq ATLRCWASTPVSG/RL
  position 8 of amino acid sequence
  unsure 9: Xaa = Glu,Lys,Met,Val
  position 9 of amino acid sequence
  unsure 10: Xaa = Ala,Gly,Pro,Arg
  position 10 of amino acid sequence
  unsure 13: Xaa = Leu,Arg; position 13 of amino acid sequence; Xaa = Met,Arg
acaaagaggcagctccggaatgagaaagataagccactgcctccactgctggcccgagtcgggggcaacattgaggtgctgggcttcaacacccgtcagcggaaggctttcctcaatggctgtkrwgssgckgggggaaakgccaccacaggatgccttcaccacacagtggctggtgcgggacctgaggggcaagactgagaaggagtttaaggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggggcag

SEQ ID NO: 1472 - DNA, 249 bp, Homo Sapiens
  Heart
  sig_peptide 172..237: Von Heijne matrix; score 4.00; seq LLHPCGSITLTSS/ST
aaaatttttttagcctctaacatgaaagggtctcttcattgttctcatttgtcttacccgccatccagtgttaagcagtatgttaaagagcttcttctttacaacttttcccctcacattattttyctacatgcagcaacttctttaaccaagttgtttgattaggagtaaatgtgcataaacgatcatattattaagcttctgcacccatgtggcagcatcactttaacttcttcctcaaccacacgg

SEQ ID NO: 1473 - DNA, 269 bp, Homo Sapiens
  kidney
  sig_peptide 135..185: Von Heijne matrix
  score 4.00
  seq VALQCGLTIPALX/LP
  misc_feature 184: n=a, g, c or t
  unsure -1: position -1 of amino acid sequence; Xaa = Cys,Phe,Ser,Tyr
agaaggggtgtcaaactccaatggaaaaggtttaggaaaagaccttttacaaatccaaagatgtttcacagtgggcgaggctggtgtggcgacagtagtggcccacatggctgggttgggagccagctctgcccatgaggtgccgtgtggctttgcagtgtggcctcacaatcccagctttgtntcttccccagggagatgaggctggtgatgctcaagatctcagaggccctgcccaggctgagtatctgtatataatatccccctcg

SEQ ID NO: 1474 - DNA, 441 bp, Homo Sapiens
  kidney
  sig_peptide 88..366: Von Heijne matrix
  score 3.90
  unsure 13: seq LTSAFLWLPRLHI/SV
  position 13 of amino acid sequence
  unsure 23: Xaa = Asp,Glu; position 23 of amino acid sequence; Xaa = Pro,Thr
atataactcagttttctgttgtctttagctactgatgcaaatgtgaagaatgaaagtctttcatctgtgcagcagcttggcattaaaatgactgtcaggtatggcaaattcctcagtctcttaaaagatggtgcagaaaatgatcttacctgggttttaaagcattgtgagagattcctgaaacagcagcaaacttccataaaatcttctcttctctgcctgcaagggaattatgctggccatgactggtttgtatcttctctgttcatgataatgttgggagacaaagaaaaaacattccaatttcttcatcaattctccaggcttctgacttctgcttttctttggttgccaaggctacatatttctgtaagacttcaatctgtttttaaaggagggtttgamattttaagaacattatacttacattcamcgggacgg

SEQ ID NO: 1475 - DNA, 261 bp, Homo Sapiens
  kidney
  sig_peptide 160..219: Von Heijne matrix; score 3.90; seq FFWVVLFSAGCKV/IT
aacagagccacagaatgctgagcagtcaacagcatttcttgttccaagatcacccttctgagtacctctctggctgccaaattgccagggccttcacagtttgattccatttctcagctccaagcattaggtaaacccaccaagcaatcctagcctgtgatggcgtttgacgtcagctgcttcttttgggtggtgctgttttctgccggctgtaaagtcatcacctcctgggatcagatgtgcattgagaaagaagccaca

SEQ ID NO: 1476 - DNA, 289 bp, Homo Sapiens
  kidney
  sig_peptide 167..232: Von Heijne matrix; score 3.90; seq HLSSTTSPPWTHA/AI
aaaaacgccttgaggataaggaaggagaatcagcaagtcccgagttcctacggtgtgtcagcatcgtgctcccactcccgggagagaggcattatcttcagtttacaaaaggggaaaacaggtctggggtttccagagtccgcggttttgctaagaagccgcagtgatgttgacgcggctggtcctcagtgcacacctgagtagcacgacctctccgccctggacgcacgctgccatcagctgggagctggacaacgtgctgatgcctagtcccagaatctggcccctg

SEQ ID NO: 1477 - DNA, 478 bp, Homo Sapiens
  kidney
  sig_peptide 326..445: Von Heijne matrix
  score 3.90
  unsure 4: seq CVNLLLGFEPVIS/RS; position 4 of amino acid sequence; Xaa = Arg,Ser
ataaaacttagggggaagatttgcctctcactttttttcttggaaaatgtgggcagcaattttaaagagaacatgaaaatggagtaggttgaaaccaacattcagaacttcctttcatggattgaaacttaaagctgagggaggktttragggtggarktraggaagggctagaagatagcaaatttcagagtcatatcagagaatatgaactgtcagtgtttccaatgtttctcttggctctgcacagcacttccaagcccttttgctcactgttttgcttctgccacacctaggagaagattcagagcttgctgaggcaaaacatgcgatatttccaagggccttccccctattctgaaatagaaattgagctttgtgatcatgtgtattcattccaaggtctatgtgttaaccttttgctaggatttgaacctgttattagtaggagccgrmgcagttcacttgctgttgagtct

SEQ ID NO: 1478 - DNA, 257 bp, Homo Sapiens
  kidney
  sig_peptide 48..170: Von Heijne matrix
  score 3.90
  seq LASLECYVPSTNQ/WQ
  misc_feature 53,73,185: n=a, g, c or t
  unsure -40: position -40 of amino acid sequence
  unsure -39: Xaa = Lys,Asn
  position -39 of amino acid sequence
  unsure -34: Xaa =  * ,Lys,Gln
  position -34 of amino acid sequence
  unsure -33: Xaa =  * ,Cys,Phe,Leu,Trp
  position -33 of amino acid sequence
  unsure -32: Xaa = Ala,Asp,Glu,Gly,His,Ile,Lys,Leu,Met,Asn,Pro,Gln,Arg,Ser,Thr,Val
  position -32 of amino acid sequence
  unsure 5: Xaa = Leu,Val
  position 5 of amino acid sequence
  unsure 6: Xaa =  * ,Phe,His,Ile,Lys,Leu,Met,Asn,Pro,Gln,Ser,Thr,Tyr; position 6 of amino acid sequence; Xaa = Ala,Pro
actgcagatacgatccccgcttcaacacctggatacacctggccagsatgaanhagaagcgcacgcactkvvnsstgagcgtgttcaacgggctcgtgtacgccgcgggcggccgcaacgcagaaggaagcctggcctcgctggagtgctacgtgccctccaccaatcagtggcagccgaaghhnsccctggaggtggcgcgctgctgccacgctagcgcggtcgccgacggccgcgtgctggtgaccggaggcttg

SEQ ID NO: 1479 - DNA, 377 bp, Homo Sapiens
  Muscle
  sig_peptide 249..362: Von Heijne matrix
  score 3.90
  seq LLFFHLLLNDFFT/FY
  misc_feature 369: n=a, g, c or t
  unsure -27: position -27 of amino acid sequence
  unsure 3: Xaa = Phe,Ile,Val; position 3 of amino acid sequence; Xaa = Phe,Ile,Leu,Val
acatccagctctggtagtttaggctcaatcttacggtgtaattatacagaataattagaggcagctgtatccttgtttctgattttaaaatctgratgtttctycaattctttgtgtactctcccttcatttggtacatatagaagtcttcttatgtgttattaaagtcttctaagatagtattctggtcattggagacaccaaaaatctatgggcacagtcctgttcctgtttcttttgccaatagaatgttccttaaggttcagtcacagtccttttacdtcccttacagagattgtttaaatttccacaaaagcacgtatttactcttctttcacttgttactaaatgacttcttcacattttacnttgctaaa

SEQ ID NO: 1480 - DNA, 226 bp, Homo Sapiens
  Muscle
  sig_peptide 119..199: Von Heijne matrix; score 3.90; seq WIILIIYTFQCNS/SL
cagaatgttctttgctgcctcgcttacatggcaaaactcacaaaccacctatacaatccaaaagaggggaaacagctcatctcatattaattatggtccatttcbatgataggatattatgcaaccattaaaaatcatattttatctgagtgttagtatatggattattttaattatttatacttttcagtgtaattcttctctgagcatactacttttggagtta

SEQ ID NO: 1481 - DNA, 192 bp, Homo Sapiens
  kidney
  sig_peptide 10..66: Von Heijne matrix
  score 3.90
  unsure 4,8: seq RVAACTAAAPLQA/HG
  position 4, 8 of amino acid sequence
  unsure 11: Xaa = Asp,Gly
  position 11 of amino acid sequence
  unsure 13: Xaa = Arg,Ser
  position 13 of amino acid sequence
  unsure 15: Xaa = Cys,Trp
  position 15 of amino acid sequence
  unsure 20: Xaa = Gly,Arg; position 20 of amino acid sequence; Xaa = Glu,Gly
aagtgatggatgatgagaacgacagcgagagtcgctgcgtgtactgctgcagccccattgcaagcccacggtgcagrcattcagcaggrtccagacagsctctgstctrgaaggctcagcagagrrggrctttctgcagggcgrctgcaccaragcgaaacagaagctgaactggargccccgggtcgcgcg

SEQ ID NO: 1482 - DNA, 274 bp, Homo Sapiens
  Kidney
  sig_peptide 140..241: Von Heijne matrix; score 3.80; seq RWASSCLHPSARS/SN
aascccaasgtgctgccgttgcccgtacaactcggacttgctgttgctcgagccgcgtctgcacgggtctcggaccgagcggagtccmagcctcggtcccggagcccaccttcgcctcgcccttgcccagcctgcggtgatggaggcggccaccacactgcacccaggcccgcgcccggcgctgcccctcggggcccgggcccgctgggcgagttcctgcctccacccgagtgcccggtcttcgaacccagctgggaagagttcgcggacccct

SEQ ID NO: 1483 - DNA, 196 bp, Homo Sapiens
  Kidney
  sig_peptide 92..178: Von Heijne matrix; score 3.80; seq LCPVIFFPSNCWK/EY
aagaaaggacattttttttttcttgtactaactaggctggattyyccaaattgtttgagtggcccctgcccctcttaatgcttctgtaagaatgcaaggtgtcaggggacctgtgtccttttcctggagcacaaccatgttgtgtcctgttatattctttccatccaactgttggaaagaatataacaggacacag

SEQ ID NO: 1484 - DNA, 236 bp, Homo Sapiens
  kidney
  sig_peptide 177..230: Von Heijne matrix
  score 3.80
  unsure -17: seq FXLLFXXFXFFRQ/XG
  position -17 of amino acid sequence
  unsure -16: Xaa = Leu,Trp
  position -16 of amino acid sequence
  unsure -12,-8: Xaa = Glu,Gly
  position -12, -8 of amino acid sequence
  unsure -7: Xaa = Phe,Leu
  position -7 of amino acid sequence
  unsure -5: Xaa =  * ,Tyr
  position -5 of amino acid sequence
  unsure 1: Xaa = Leu,Pro; position 1 of amino acid sequence; Xaa = Ala,Ser
acaagtctgtcctccctaggctggcagctctgtcagcacccaggttgttagaatagttgttaaaacaggtcattctgttgccaagtaattacggggccttgsactcagtaaccttccccacgaagcaggccgtagtgtgcttactgctctcccttgsctttccatcccctactttgatgtkggrrttttctttcyttttacttttcytttawtttcyttttttccgccagkctggg

SEQ ID NO: 1485 - DNA, 451 bp, Homo Sapiens
  kidney
  sig_peptide 359..427: Von Heijne matrix; score 3.80; seq SVRLLFRFSVIMA/SE
acactgtgaaatgcaattgtgccttgaataagaaggtacctagaagccaaattaaagtaataatgacttcttattggctttgatttttcattgcagtatatgggaattgtacagcaggaaatgcttatcattaatttctgatgttttttaaagcacaactcgaaacatttcgatcatacatacatagcagtagagatctgtgcccttcaggtacattgwatctgaccatcagtttatatatgtcattgaattttaagaatactcatgttaataatagtcatctatccttgcattttgaaactgttctaatcttagtgaacttgaattggatttctgggtaaaagaatgtgtttcttttatgttgcttctgtccgaagccttgtcagaatctgtcagactcttgtttaggtttagtgtgatcatggcgtcagagaagcaaagctttcaaata

SEQ ID NO: 1486 - DNA, 399 bp, Homo Sapiens
  kidney
  sig_peptide 319..369: Von Heijne matrix; score 3.80; seq SLPCTTAFPLLSS/KV
attcttctctggttacctctatctacccccgagtcaacaagccctgcctgattacgcagcagcagtttctcctggagagtatatgcccttccctaccagagtggctgtgctctgtggaccaacggcatttgtgccgtggctggtgtttccaccattccagtgggttggctgcagagttatcctttgtgggtgggagagagcaccaggcctcaggaatctccctgctggtcccagcctccatctcctcctccccaaccctgaacctctcccgcaacctgcacctcccccgagaagccagccacagaggcagagagcatcatggctcttatcagcctgccatgcacgacagctttccctttactgtccagcaaggtttcccagcttctcttgcccctcagc

SEQ ID NO: 1487 - DNA, 253 bp, Homo Sapiens
  Heart
  sig_peptide 83..193: Von Heijne matrix; score 3.80; seq RVVALPLVRATCT/AV
agtggagagtcgagcctggggtcggcggagacwgctggtgtctgaagccgctcgcgcccagggtgaccctgtttgcagcacgatgtctgaagaagaggcggctcagatccccagatccagtgtgtgggagcaggaccagcagaacgtggtgcagcgtgtggtggctctgcccctggtcagggccacgtgcaccgcggtctgcgatgtttacagtgcagccaaggacaggcacccgctgctgggctccgcctgg

SEQ ID NO: 1488 - DNA, 298 bp, Homo Sapiens
  kidney
  sig_peptide 8..223: Von Heijne matrix; score 3.80; seq LAELTVDPQGALA/IR
aaaaaagatggcggcggcggcggcagctggtgcggcctccgggctgccgggtccagtggcacaaggattaaaggaagcgttagtggatacgctcaccgggatcctatccccagtacaggaggtgcgggcggctgctgaagaacagattaaggtgctggaggtgacggaggaatttggtgttcacttggcagaactgactgtagatccccagggggcactggcaatccgtcagctggcatcagtcatcttgaaacaatatgtggagactcactggtgtgcccaatcagagaaatttagg

SEQ ID NO: 1489 - DNA, 503 bp, Homo Sapiens
  kidney
  sig_peptide 114..464: Von Heijne matrix
  score 3.80
  seq XXXYLNFCPVCYC/FS
  misc_feature 431: n=a, g, c or t
  unsure -55: position -55 of amino acid sequence
  unsure -28: Xaa =  * ,Glu,Gly,Lys,Arg
  position -28 of amino acid sequence
  unsure -26: Xaa = Ala,Gly
  position -26 of amino acid sequence
  unsure -13: Xaa = Asp,Asn
  position -13 of amino acid sequence
  unsure -12: Xaa = Phe,Val
  position -12 of amino acid sequence
  unsure -11: Xaa =  * ,Cys,Trp; position -11 of amino acid sequence; Xaa = Cys,Phe,Ile,Leu,Pro,Arg,Ser,Thr
gtgaattcgccagcgggagcgcgctcgcggwccgcgcgttctccgctttcccggctccgtcgctgacgcgtcgtagasttggsvwgcgggaaggcaacggcagcgggatcgggatgaacagcggcggcggcttcggtttgggcttaggcttcggcctcacccccacgtcggtgattcaggtgacgaatctgtcgtcggcggtgaccagcgagcagatgcggacgcttttttccttcctaggagaaatcgaggagctgcggctctaccccccggacaacgcacctcttgctttttcctcbdragtatgttatgttaagtttcgtgatccatcaagtgttggagtggcccagcatctaactaacacggtttttattgacagagstctgratagttgttccttgtgcagaaggttggtatctcgctttktttgnhbttatttgaatttctgtcctgtctgttattgctttagctttcctagagattggcaagtagacagtactctc

SEQ ID NO: 1490 - DNA, 175 bp, Homo Sapiens
  Dystrophic muscle
  sig_peptide 47..85: Von Heijne matrix; score 3.70; seq MIEMLIFLDCVLS/SK
attaacaaagagcaagtttaacctgagtggtcaacttttgcagcagatgattgaratgctaatatttctagactgtgtcctgtcttccaaagatacaataaccatgtttgtgaagttcatacctatttttccttttcctttgcagttttatttgccctctttccttcttttggag

SEQ ID NO: 1491 - DNA, 291 bp, Homo Sapiens
  kidney
  sig_peptide 49..285: Von Heijne matrix; score 3.70; seq VIGSLLVLTMLTC/RR
acatcacaaaaattaggtgaccatggttatgataattctttgcctagtatgcatccatttctagctgcccacggacctgcatttcacaaaggctacaagcatagcacaattaacattgtggatatttatccaatgatgtgccacatcctgggattaaaaccacatcccaataatgggacctttggtcatactaagtgcttgttagttgaccagtggtgcattaatctcccagaagccatcgcgattgttatcggttcactcttggtgttaaccatgctaacatgccgccgg

SEQ ID NO: 1492 - DNA, 122 bp, Homo Sapiens
  Kidney
  sig_peptide 33..74: Von Heijne matrix; score 3.70; seq IWPMSASVATLWS/FT
atcttagtgtgacacatgaacccctccccttcatgatctggcctatgtctgcctctgtagctactctctggtcctttacctcttacataagctacccaagcaggttttactatgatgcttgg

SEQ ID NO: 1493 - DNA, 266 bp, Homo Sapiens
  kidney
  sig_peptide 12..104: Von Heijne matrix
  score 3.60
  unsure 4: seq LFIYLVFVECLLC/TR
  position 4 of amino acid sequence
  unsure 5: Xaa =  * ,Trp
  position 5 of amino acid sequence
  unsure 6: Xaa = Asp,Glu
  position 6 of amino acid sequence
  unsure 9: Xaa = Arg,Ser; position 9 of amino acid sequence; Xaa =  * ,Gly
aagggtaatggatgggaattgatattttctatccttcacacatcccagactttcatcctattcatttattcatttatctagtgtttgtagagtgccttctgtgtaccaggaactgrgawagkttgtcckgattcaactgtgataacgctcaaataatcttcacaacaggctcatcctctagtggaggaaataaaccatttaaaagtagtttatgtacagtacatagaggccaagaaagggaaagaatagagtgccaagggaatggg

SEQ ID NO: 1494 - DNA, 371 bp, Homo Sapiens
  kidney
  sig_peptide 24..284: Von Heijne matrix
  score 3.60
  unsure -37: seq LILQASLKGELEA/SQ; position -37 of amino acid sequence; Xaa = Ser,Thr
aaatagctgattatgaacgtttgatgaaagaactaaatcaaaagttaactaataaaaacaacaagatagaagatttggagcaagaaataaaaattcaaaaacagaaacaagaaaccctacaagaagaaataacttcattacagtcttcagtacaagaatatgaagaaaaaaacwccaaaatcaagcaattgcttgtgaaaaccaaaaaggaactggcagattcaaagcaagcagaaactgatcacttaatacttcaagcatctttaaaaggtgagctggaggcaagccagcagcaagtagaagtctataaagtaagggttttactttttaagattaaaaaaatgttttttcatgtagaagtgaggaacggg

SEQ ID NO: 1495 - DNA, 383 bp, Homo Sapiens
  kidney
  sig_peptide 33..371: Von Heijne matrix; score 3.60; seq RLLLCILIIVCYI/LF
acagtcctacctttgctgatgcctactctaatatgggaaacactctaaaggagatgcaggatgttcagggagccttgcagtgttatacgcgtgccatccaaattaatcctgcatttgcagatgcacatagcaatctggcttccattcataaggattcagggaatattccagaagccatagcttcttaccgcacggctctgaaacttaagcctgattttcctgatgcttattgtaacttggctcattgcctgcagattgtctgtgattggacagactatgatgagcgaatgaagaagttggtcagtattgtggctgaccagttagagaagaataggttgcttctgtgcatcctcatcatagtatgctatatcctctttctcatg

SEQ ID NO: 1496 - DNA, 217 bp, Homo Sapiens
  Dystrophic muscle
  sig_peptide 92..208: Von Heijne matrix; score 3.60; seq VAYAIPSIPSLFC/QR
acatgttgagtactttttcctcacctgtttttccattcctgttagccggagcaaaagggcctccaactcctcttttagagagaaatgactaatgctcatactagcagataccagacgtgtccaaggaggtaccttgggcttaattccagcagttctcaacagagtccacgtggcatatgctatacccagcatacctagcctcttctgccagcgctgg

SEQ ID NO: 1497 - DNA, 450 bp, Homo Sapiens
  kidney
  sig_peptide 343..402: Von Heijne matrix; score 3.60; seq CVFLFPLISNTSS/YK
cacacaattaatattaatggataactaattggagtaatgattattagctactgaatgctgataatagaagtcatatttaaatgcttacttagttacttaagttagtcaaggactctgaaaaaaataaggtttaaagttaacagtgtcatcagtcattcccagttatcttcttatttaagaacaagatggtaatgcagttgcctttgtttatttaaatagaaaaaattaaatcaggataaaatgacccaactacagtgatgtatttggacacactacttcttatctttcaatatagacttttatttctggattaccatagatggaaatagtattactggacatatgttggtaggtatttacttctgtgtttttctttttcccttaatttcgaatacttctagctacaaaaattgtcataaaactttgcaacacactatacctccccacggg

SEQ ID NO: 1498 - DNA, 201 bp, Homo Sapiens
  kidney
  sig_peptide 1..126: Von Heijne matrix
  score 3.50
  unsure 10: seq LLLQGACPCLIFL/RP; position 10 of amino acid sequence; Xaa = Glu,Gly
atgtttctcgctccctctctgctgatcacaaagctgctgaccgggtcagaaagtcctgatggaaatccaccagcgctgggcaggcccctcctcctccagggagcttgtccttgcctaatttttcttcgtcctgatgagaacaaaaaagagggggrggaggaaaagaaaaaccacaaacttcctttgaaaaccagcttaggg

SEQ ID NO: 1499 - DNA, 306 bp, Homo Sapiens
  Dystrophic muscle
  sig_peptide 235..288: Von Heijne matrix; score 3.50; seq SKSCLFYLQKVSG/IP
aaaggtggcttcaggaccacctcctgagagcttcgttgtatttcatgtatatttccccaaatatatcagcatctgacccttggcttctgggagaaagacagaggcggaaccctggccgccccagagagaggcagctgtgggggcagagatgtaacaaccctttgaaccttgaccttggacgccaggctgtccgggagcttctcccacaatggctgttttggggatgtgacctggatggacccatctgctagcaaatcctgtctgttttacctccaaaaagtatctggaattccagggcttctcacc

SEQ ID NO: 1500 - DNA, 251 bp, Homo Sapiens
  kidney
  sig_peptide 54..191: Von Heijne matrix; score 3.50; seq RWLCLQAYLASFS/LE
acgtgtcctcaggattttcctcttgggctggacagtttgctcccctggagggtatgagcctgactgctagtgggccaagagctgcctgggaggaaagggtggggggtctccacacttggggtgccaacattcctaccgcccctgattcccagcggtggctctgtcttcaggcgtacctggcatccttcagtcttgagagcccccacagaatctacctkgaatctcctcccacgctccttttccccccgccg

SEQ ID NO: 1501 - DNA, 242 bp, Homo Sapiens
  kidney
  sig_peptide 117..182: Von Heijne matrix; score 3.50; seq AQLASPLLPGATP/VA
accgcagaaaatgctaggtgcaaagtttgtcgaaagaaaggtgaggatgacaaattgatcttgtgtgatgagtgtaataaagccttyccacctgttttgtctgaggccggccctctatgaagtaccagatggtgagtggcagtgcccagcttgccagcccgctactgccaggcgcaactcccgtggcaggaactatactgaagagtctgcttctgaggacagtgaagatgatgagagtgatg

SEQ ID NO: 1502 - DNA, 342 bp, Homo Sapiens
  kidney
  sig_peptide 229..333: Von Heijne matrix
  score 3.50
  seq CFWGLMYXWLLLG/SX
  misc_feature 337: n=a, g, c or t
  unsure -6: position -6 of amino acid sequence
  unsure 2: Xaa = Ile,Met; position 2 of amino acid sequence; Xaa =  * ,Glu,Lys,Gln
acatctgatcgataattatgtcacctgtacctgtcgccagcttgtcttgttatgacgttagttttactgctagaaatatctagtagatggctggaaatctgcaggcaaagtgcagagggagtgagcctgcgaggagagggsctgggcaaagtgambgccctgggccgcagagttcttatctaaaaaatgggaacagtagtgtcttcctaaaggcaccatggacttaaaatgaatggcacgtttcctgggacttatgtatatttggttgcttatggggacttacgtatatttggttgcttttggggacttatgtatatktggttgcttttggggtctnaaggg

SEQ ID NO: 1503 - DNA, 340 bp, Homo Sapiens
  Muscle
  sig_peptide 50..112: Von Heijne matrix
  score 12.70
  misc_feature 131..222: seq ILFLLSWSGPLQG/QQ; blastn; identity 98; region 66..157
  id AA134726
  misc_feature 216..282: est; blastn; identity 97; region 152..218
  id AA134726
  misc_feature 283..342: est; blastn; identity 90; region 220..279
  id AA134726
  misc_feature 64..103: est; blastn; identity 100; region 1..40
  id AA134726
  misc_feature 98..130: est; blastn; identity 93; region 34..66
  id AA134726
  misc_feature 81..285: est; blastn; identity 97; region 1..205
  id R17226
  est
  misc_feature 301..302,304: n=a, g, c or t
  unsure 60: position 60 of amino acid sequence
  unsure 64: Xaa = Asp,Gly; position 64 of amino acid sequence; Xaa =  * ,Ala,Cys,Asp,Glu,Gly,His,Lys,Asn,Pro,Gln,Arg,Ser,Thr,Trp,Tyr
gaggctgactgtacgttccttctactctggcaccactctccaggctgccatggggcccagcacccctctcctcatcttgttccttttgtcatggtcgggacccctccaaggacagcagcaccaccttgtggagtacatggaacgccgactagctgctttagaggaacggctggcccagtgccaggaccagagtagtcggcatgctgctgagctgcggaacttcaagaacaagatgctgccactgctggaggtggcagagaaggagcgggaggcactcagaactgaggccgrcaccatctcnnvnggagtggatcgtctggagcgggaggtagactatctg

SEQ ID NO: 1504 - DNA, 321 bp, Homo Sapiens
  kidney
  sig_peptide 76..141: Von Heijne matrix
  score 10.50
  misc_feature 124..310: seq LMLLVSSLSPVQG/VL; blastn; identity 100; region 46..232
  id T39765
  misc_feature 78..123: est; blastn; identity 95; region 1..46; id T39765; est
aaaataggagtctctggtactgcaaacccacagcctggactcagagctcaagtctgaactctacctccagacagaatgaagttcatctcgacatctctgcttctcatgctgctggtcagcagcctctctccagtccaaggtgttctggaggtctattacacaagcttgaggtgtagatgtgtccaagagagctcagtctttatccctagacgcttcattgatcgaattcaaatcttgccccgtgggaatggttgtccaagaaaagaaatcatagtctggaagaagaacaagtcaattgtgtgtgtggacctcaagcatagg

SEQ ID NO: 1505 - DNA, 426 bp, Homo Sapiens
  kidney
  sig_peptide 16..156: Von Heijne matrix
  score 8.00
  misc_feature 241..426: seq VLELLAAVCLVRG/GH; blastn; identity 98; region 1..186
  id T07474
  unsure 72: est
  position 72 of amino acid sequence
  unsure 76: Xaa = Ala,Asp; position 76 of amino acid sequence; Xaa = Asp,Gly
agtttacgtgccatcatgaattatcagtatggtttcaacatggtcatgtctcatccacacgctgtcaatgagattgcactaagcctgaacaacaagaatcccagaacaaaagcccttgtcttagaactgttggcagccgtttgtcttgtcagaggcgggcatgaaatcattttatcagcatttgataactttaaagaggtttgtggagaaaaacagcgctttgagaagttgatggaacatttcaggaatgaagacaataacatagattttatggtggcttctatgcagtttattaatattgtagtccattcagtagaagatatgaatttcagagttcacctgcagtatgaatttaccaaattaggcctggmcgaatacttggrcaagctgaaacacactgagagtgacaagcttcaagtccagatc

SEQ ID NO: 1506 - DNA, 387 bp, Homo Sapiens
  kidney
  sig_peptide 205..288: Von Heijne matrix
  score 7.70
  misc_feature 246..387: seq LVMCFLSYFGTFA/VE; blastn; identity 100; region 1..142
  id HUM75821
  misc_feature 246..387: est; blastn; identity 100; region 1..142
  id T08488
  misc_feature 261..387: est; blastn; identity 100; region 1..127; id R54273; est
attggtaattttcagctcacaaatgatgaagaaatccataacgtcggaacttccttgacctttggatttggcacattgacctgctggatccaggctgcgctgacactcaaggtcaacatcaasaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcag

SEQ ID NO: 1507 - DNA, 339 bp, Homo Sapiens
  kidney
  sig_peptide 76..138: Von Heijne matrix
  score 7.10
  misc_feature 124..335: seq LHLFHLLIRPXQG/WX; blastn; identity 95; region 1..212
  id AA081335
  misc_feature 212..309: est; blastn; identity 95; region 1..98
  id H88204
  misc_feature 296..335: est; blastn; identity 100; region 82..121
  id H88204
  misc_feature 284..335: est; blastn; identity 100; region 1..52
  id W31695
  est
  misc_feature 50: n=a, g, c or t
  unsure -3: position -3 of amino acid sequence
  unsure 2: Xaa = Cys,Trp
  position 2 of amino acid sequence
  unsure 3: Xaa = Glu,Lys; position 3 of amino acid sequence; Xaa = Glu,Gly
actctctgctgaactcccaaagggagtgtgtgtatttcctcccgttcttnatcagagcccccaaaataagtaggaatgggcagtggctattcacattcactacaccttttccatttgctaataaggccctgscaaggttggraggraattgtccctgcctgcttctggagaaagaagatattgacaccatctacgggcaccatggaactgcttcaagtgaccattctttttcttctgcccagtatttgcagcagtaacagcacaggtgttttagaggcagctaataattcacttgttgttactacaacaaaaccatctataacaacaccaaacacgtgg

SEQ ID NO: 1508 - DNA, 363 bp, Homo Sapiens
  Muscle
  sig_peptide 157..204: Von Heijne matrix
  score 6.70
  misc_feature 209..324: seq CFSLVLLLTSIWT/TR; blastn; identity 97; region 1..116
  id AA081350
  misc_feature 277..324: est; blastn; identity 97; region 3..50
  id AA046671
  est
  misc_feature 275..276,325..326,328: n=a, g, c or t
  unsure 24: position 24 of amino acid sequence
  unsure 25: Xaa = Ala,Asp,Glu,Gly,Val
  position 25 of amino acid sequence
  unsure 41: Xaa = Ile,Val
  position 41 of amino acid sequence
  unsure 42: Xaa = any one of the twenty amino acids
  position 42 of amino acid sequence
  unsure 45: Xaa =  * ,Glu,Lys,Gln
  position 45 of amino acid sequence
  unsure 46: Xaa = His,Leu,Gln; position 46 of amino acid sequence; Xaa =  * ,Lys
agggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaagagctttccatccaggtgtcatgcagaattatggnnrtcacccttgtgagcaaaaaggcgaaccagcagctgaatttcacagaannvnaaggaggccwwwargctgctgggactaagtttggc

SEQ ID NO: 1509 - DNA, 290 bp, Homo Sapiens
  Heart
  sig_peptide 171..269: Von Heijne matrix
  score 6.70
  misc_feature 20..194: seq MTCLSVLFGYATS/HP; blastn; identity 96; region 144..318
  id AA045920
  misc_feature 194..257: est; blastn; identity 100; region 319..382
  id AA045920
  misc_feature 20..226: est; blastn; identity 94; region 153..359
  id N25870
  misc_feature 220..262: est; blastn; identity 95; region 355..397
  id N25870
  misc_feature 20..176: est; blastn; identity 94; region 143..299
  id H99323
  misc_feature 212..267: est; blastn; identity 92; region 335..390
  id H99323
  misc_feature 67..262: est; blastn; identity 95; region 1..196; id AA150024; est
aatcttgtcagaagtcgtcgaaaatatttacaccagcagctccagttcataccaataaagaagatcctgctacccaaactaatttgggrwttatccawgcatttgkcgctgccatatcagttattawtgkatcygaattgggtgataagacattttttatagcagccatcatggcaatgcgctataaccgcctgaccgtgctggctggtgcaatgcttgccttgggactaatgacatgcttgtcagttttgtttggctatgccaccagtcatccccagggkctatacata

SEQ ID NO: 1510 - DNA, 369 bp, Homo Sapiens
  kidney
  sig_peptide 211..288: Von Heijne matrix
  score 6.30
  misc_feature 319..370: seq RQLLLPLPPFSFP/AP; blastn; identity 92; region 31..82
  id R51759
  misc_feature 288..318: est; blastn; identity 100; region 1..31; id R51759; est
agtcaattctaggagccatcaagcatgaaagtggttctgtctcctgagcgcaasctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggscac

SEQ ID NO: 1511 - DNA, 390 bp, Homo Sapiens
  kidney
  sig_peptide 121..360: Von Heijne matrix
  score 6.20
  misc_feature 117..390: seq RASLLPMLLGSWA/FL; blastn; identity 99; region 1..274
  id C16636
  est
  misc_feature 261: n=a, g, c or t
  unsure -34: position -34 of amino acid sequence; Xaa = Ile,Met
aaaaaagagctggttccctggcaggctggagggcaggagctggggccacgctggtctgggatagttgggcagggaggctgtctacctggtcttccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatntctgccaggagatggccaagaagggatgcagacacctggtgtgctcctcagggggtaatgcgggcatcgctgctgcctatgctgctaggaagctgggcattcctgccaccatcgtgctccccgagagca

SEQ ID NO: 1512 - DNA, 449 bp, Homo Sapiens
  Muscle
  sig_peptide 165..284: Von Heijne matrix
  score 6.00
  misc_feature 86..409: seq LTYGIILTHGASG/DM; blastn; identity 97; region 50..373
  id AA147010
  misc_feature 132..450: est; blastn; identity 91; region 156..474
  id AA142584
  misc_feature 222..450: est; blastn; identity 99; region 1..229
  id AA043641
  misc_feature 101..304: est; blastn; identity 98; region 72..275
  id T18932
  misc_feature 132..243: est; blastn; identity 90; region 146..257
  id AA123074
  unsure 50: est; position 50 of amino acid sequence; Xaa = Glu,Lys
aacgctgtggcggggcaggcgaggcggtcgcttcgagcgcgctagtcagctccctgaagggagtgacggcggttgggtgcccgcggccacttttgccttcccggggagatgtcctttgcttctcagatgtaaakgcactttaagtttgkwattcaacagtgaaaatgagtcatacagaggttaaattaaaaataccttttggaaataaattactagatgctgtttgtttggtacctaacaagagcttaacatatggaataattcttacacatggagcatcaggagatatgaatcttcctcatttgatgtcactggcatcccatcttgcatctcatgggtttttctgcctgagatttacctgtaaaggccttaatattgtacatagaattaaggcgtataaatcagttttgaattacctgaagacatcaggmraatacaaacttgcaggt

SEQ ID NO: 1513 - DNA, 258 bp, Homo Sapiens
  kidney
  sig_peptide 31..150: Von Heijne matrix
  score 6.00
  misc_feature 75..254: seq LCXEFXSVASCDA/AV; blastn; identity 97; region 1..180
  id T31666
  misc_feature 73..126: est; blastn; identity 92; region 88..141
  id R58665
  misc_feature 23..77: est; blastn; identity 90; region 39..93
  id R58665
  misc_feature 157..231: est; blastn; identity 98; region 63..137
  id R14990
  misc_feature 95..144: est; blastn; identity 94; region 1..50
  id R14990
  misc_feature 135..254: est; blastn; identity 99; region 1..120
  id T26956
  unsure -11: est
  position -11 of amino acid sequence
  unsure -8: Xaa = Leu,Val
  position -8 of amino acid sequence
  unsure 9: Xaa = Ala,Thr
  position 9 of amino acid sequence
  unsure 36: Xaa = Asp,Glu; position 36 of amino acid sequence; Xaa = Gly,Arg,Trp
aaaaaggggcggtgcagaggcggcaggaagatggagttggggagttgcctggagggcgggagggaggcggcggaggaagagggcgagcctgaggtgaaaaagcggcgacttctgtgtstrgagtttrcctcggtcgcaagctgcgatgccgcagtggctcagtgcttcctggccgakaacgactgggagatggaaagggctctgaactcctacttcgagcctccggtggaggagagcgccttggaacgccgaccadgg

SEQ ID NO: 1514 - DNA, 318 bp, Homo Sapiens
  kidney
  sig_peptide 148..255: Von Heijne matrix
  score 5.80
  misc_feature 138..317: seq AFVSGLLIGQCSS/QK; blastn; identity 98; region 52..231
  id AA099777
  misc_feature 85..135: est; blastn; identity 94; region 1..51
  id AA099777
  misc_feature 138..222: est; blastn; identity 95; region 83..167
  id HSB16C031
  misc_feature 80..135: est; blastn; identity 94; region 27..82
  id HSB16C031
  misc_feature 145..314: est; blastn; identity 91; region 43..212; id AA068028; est
aggcagtgaattgagaccggagggaatctggcccctagaggctggtacttgggcccgaaacccccatctccggcggagagaccgtccgaggtaattgtctgccacgagtgcacattctgaaaacaggrgrwtttaagkttcctaaaaatgggaagaacctacattgtagaagagactgttggccagtatctttcaaacataaatctccaaggaaaggcttttgtctctggccttttaataggacagtgttcgtcacaaaaggattatgtgattcttgccactagaacgccacccaaagaggagcaaagtgagaacttg

SEQ ID NO: 1515 - DNA, 474 bp, Homo Sapiens
  kidney
  sig_peptide 109..171: Von Heijne matrix
  score 5.60
  misc_feature 227..433: seq CLSCLLIPLALWS/II; blastn; identity 100; region 1..207
  id R16604
  misc_feature 432..474: est; blastn; identity 100; region 207..249
  id R16604
  misc_feature 227..440: est; blastn; identity 98; region 1..214; id N99558; est
agtatttcacactgagattgtcggctgcgggtatattccaattccccgtctcctcatgaatatgaagtgaagggctctgaccctggaagtggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgc

SEQ ID NO: 1516 - DNA, 459 bp, Homo Sapiens
  kidney
  sig_peptide 10..72: Von Heijne matrix
  score 5.60
  misc_feature 128..341: seq CLSCLLIPLALWS/II; blastn; identity 98; region 1..214
  id N99558
  misc_feature 399..459: est; blastn; identity 95; region 278..338
  id N99558
  misc_feature 359..407: est; blastn; identity 93; region 237..285
  id N99558
  misc_feature 128..334: est; blastn; identity 100; region 1..207
  id R16604
  misc_feature 333..386: est; blastn; identity 100; region 207..260
  id R16604
  unsure 114: est; position 114 of amino acid sequence; Xaa = Ala,Thr
aagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactrctggacgtttccttacagattctagcatatggattcagtgcctggaa

SEQ ID NO: 1517 - DNA, 453 bp, Homo Sapiens
  kidney
  sig_peptide 346..408: Von Heijne matrix
  score 5.50
  misc_feature 61..399: seq SFLPSALVIWTSA/AF; blastn; identity 98; region 6..344
  id H09880
  misc_feature 408..454: est; blastn; identity 95; region 355..401
  id H09880
  misc_feature 60..399: est; blastn; identity 97; region 56..395
  id H29351
  misc_feature 393..432: est; blastn; identity 90; region 391..430
  id H29351
  misc_feature 65..369: est; blastn; identity 98; region 41..345
  id H94779
  misc_feature 118..455: est; blastn; identity 99; region 1..338
  id N27248
  misc_feature 122..399: est; blastn; identity 98; region 1..278
  id T74091
  misc_feature 393..434: est; blastn; identity 95; region 273..314
  id T74091
  est
  misc_feature 115: n=a, g, c or t
actccttttagcataggggcttcggcgccagcggccagcgctagtcggtctggtaagtgcctgatgccgagttccgtctctcgcgtcttttcctggtcccaggcaaagcggasgnagatcctcaaacggcctagtgcttcgcgcttccggagaaaatcagcggtctaattaattcctctggtttgttgaagcagttaccaagaatcttcaaccctttcccacaaaagctaattgagtacacgttcctgttgagtacacgttcctgttgatttacaaaaggtgcaggtatgagcaggtctgaagactaacattttgtgaagttgtaaaacagaaaacctgttagaaatgtggtggtttcagcaaggcctcagtttccttccttcagcccttgtaatttggacatctgctgctttcatattttcatacattactgcagtaacactccaccatata

SEQ ID NO: 1518 - DNA, 282 bp, Homo Sapiens
  kidney
  sig_peptide 106..228: Von Heijne matrix
  score 5.40
  misc_feature 11..277: seq PLIFSLWCSGVLL/HI; blastn; identity 92; region 29..295
  id AA041777
  misc_feature 56..277: est; blastn; identity 99; region 1..222
  id HSC1QB111
  misc_feature 135..281: est; blastn; identity 97; region 56..202
  id H10738
  misc_feature 81..133: est; blastn; identity 100; region 1..53
  id H10738
  misc_feature 75..277: est; blastn; identity 97; region 6..208
  id HSC2KE111
  misc_feature 89..263: est; blastn; identity 98; region 2..176; id W24981; est
aagagtgcgcggrsattggggctttccagctctcacagaaccttcagcatccccagctgccggtcttggcatcttcgaagtaaggagagttttagatgcttctggatgttcaatgctagcacctttacagactggagcagctcgattttcttcgtatttactttcaagagcaagaaaagtgctgggctcccacttattttctccctgtggtgttccggagttctgctccatatccaccagaaagctggcggcccacggctttggcgcatccatggcgagcag

SEQ ID NO: 1519 - DNA, 332 bp, Homo Sapiens
  kidney
  sig_peptide 222..308: Von Heijne matrix
  score 13.40
  misc_feature 155..334: seq SLLLVQLLTPCSA/QF; blastn; identity 98.3000030517578; region 1..181
  id HSU90144
  misc_feature 218..328: vrt; blastn; identity 100; region 90..200
  id T70246
  misc_feature 128..216: est; blastn; identity 97; region 1..89
  id T70246
  misc_feature 170..328: est; blastn; identity 96; region 50..208
  id T70127
  misc_feature 219..328: est; blastn; identity 100; region 62..171
  id AA114263
  misc_feature 159..218: est; blastn; identity 96; region 1..60
  id AA114263
  est
  misc_feature 71: n=a, g, c or t
gactcttactgtttctcatggtgagaagacaatatttgctttctctttttcctttcttccggatgagaggntaagccataatagaaagaatggagaattattgattgaccgtctttattctgtgggctctgattctccaatgggaataccaagggatggttttccatactggaacccwwaggtaaagacactcaaggacagacatttttggcagagcatagatgaaaatggcaagttccctggctttccttctgctcaactttcatgtctccctcctcttggtccagctgctcactccttgctcagctcagttttctgtgcttggacctctg

SEQ ID NO: 1520 - DNA, 414 bp, Homo Sapiens
  kidney
  sig_peptide 274..399: Von Heijne matrix
  score 5.20
  misc_feature 182..411: seq LLFDLVCHEFCQS/DD; blastn; identity 99; region 1..230
  id C15003
  misc_feature 182..411: est; blastn; identity 99; region 1..230
  id HUM407E11B
  misc_feature 182..369: est; blastn; identity 100; region 1..188
  id C15677
  misc_feature 212..369: est; blastn; identity 99; region 26..183; id HUM169E08B; est
accaggaacatccagctatttatgatagcatttgcttcattatgtcaagttcaacaaatgttgacttgctggtgaaggtgggggaggttgtggacaagctctttgatttggatgagaaactaatgttaagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccagcccgg

SEQ ID NO: 1521 - DNA, 419 bp, Homo Sapiens
  kidney
  sig_peptide 114..242: Von Heijne matrix
  score 5.20
  misc_feature 66..96: seq PMQLLQVLSDVLA/EI; blastn; identity 96; region 1..31
  id AA017364
  unsure -17: est; position -17 of amino acid sequence; Xaa = Asp,Val
aaaccgttgccaaggagctcgactctgggagcggtctagagcccgggcgcctcctggggggtggggaaacggtttcgtgaggagaatttgagttaaaattataagacctaattatgagtgatcaaattaaattcattatggacagtctcaataaggagccctttaggaagaactataatttaatcacgtttgwttccttggagccaatgcaactattacaagttctcagtgatgttctggctgagattgacccaaagcaacttgtggatatcagagaggagatgccagagcagacagccaaacgaatgttgagccttcttggtattcttaagtacaaaccttcaggaaatgccacagatatgagtacttttcgtcagggtttggtgattggaagtaaacctgtaatttacccagtgctc

SEQ ID NO: 1522 - DNA, 371 bp, Homo Sapiens
  kidney
  sig_peptide 93..329: Von Heijne matrix
  score 4.60
  misc_feature 53..203: seq IIHAXGLVRECLA/XT; blastn; identity 96; region 1..151
  id T34361
  misc_feature 205..358: est; blastn; identity 93; region 152..305
  id T34361
  misc_feature 205..342: est; blastn; identity 94; region 131..268
  id HSC16A051
  misc_feature 74..203: est; blastn; identity 94; region 1..130
  id HSC16A051
  misc_feature 340..373: est; blastn; identity 94; region 267..300
  id HSC16A051
  misc_feature 61..256: est; blastn; identity 95; region 41..236
  id T35252
  misc_feature 255..302: est; blastn; identity 93; region 236..283
  id T35252
  misc_feature 60..146: est; blastn; identity 94; region 57..143
  id H92421
  misc_feature 205..278: est; blastn; identity 95; region 200..273
  id H92421
  misc_feature 61..203: est; blastn; identity 95; region 85..227
  id T19059
  misc_feature 205..270: est; blastn; identity 93; region 228..293
  id T19059
  unsure -73: est
  position -73 of amino acid sequence
  unsure -50: Xaa = Asp,Tyr
  position -50 of amino acid sequence
  unsure -37: Xaa = Met,Val
  position -37 of amino acid sequence
  unsure -9: Xaa = Glu,Gly
  position -9 of amino acid sequence
  unsure 1: Xaa = Pro,Arg,Thr; position 1 of amino acid sequence; Xaa = Asp,Glu
aagacctgggcgtctggaatgatctacgtgcttaaatacaccactcgccaccattttctccagctgggagtgtccactcgccttccaccagcatggcaacgtcktcacagkaccgccagctgctcagtgactacgggccaccgtccctaggctacacccagggaactgggaacagccarrtgccccaaagcaaatacgcggagctgctggccatcattgragagctggggaaggagatcagacccatgtacgcagggagcaagagtgccatggagaggctgaagcgcggcatcattcacgctmsaggmctrgttcgggagtgcttggcagamacggaacgaatgccagatcctagctgccttgttggtttt

SEQ ID NO: 1523 - DNA, 235 bp, Homo Sapiens
  kidney
  sig_peptide 59..103: Von Heijne matrix
  score 4.50
  misc_feature 107..234: seq LLGAAAVAALGRG/RA; blastn; identity 100; region 1..128; id N88564; est
aaccggcagctgaacccacccggcgccacgggactttgacgcgtgctctgcgcttgccatgagactcctgggagctgcagccgtcgcggctctggggcgcggaagggcccccgcctccctaggctggcagaggaagcaggttaattggaaggcctgccgatggtcttcatcaggggtgattcctaatgaaaaaatacgaaatattggaatctcagctcacattgattctgggaag

SEQ ID NO: 1524 - DNA, 165 bp, Homo Sapiens
  kidney
  sig_peptide 13..60: Von Heijne matrix
  score 4.50
  misc_feature 13..162: seq RLLLRRFLASVIS/RK; blastn; identity 95; region 20..169
  id N41898
  misc_feature 26..162: est; blastn; identity 95; region 38..174
  id H69272
  misc_feature 45..162: est; blastn; identity 97; region 1..118; id N20619; est
aattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcgccgggg

SEQ ID NO: 1525 - DNA, 217 bp, Homo Sapiens
  kidney
  sig_peptide 122..169: Von Heijne matrix
  score 4.40
  misc_feature 59..214: seq LNSLSALAELAVG/SR; blastn; identity 98; region 1..156; id AA069390; est
aaggagagtcacgtgagagtgggcggagggggtggaggtttgtctccgctgtttcatctctatggctgtcagaggtgggcggctttgaccgagaggctgctggagctcgtgtttggacgcgatgtttcgtctgaactcactttctgctttggcagaactggctgtgggttctcgatggtaccatggaggatcacagcccatccagatccggctagcg

SEQ ID NO: 1526 - DNA, 358 bp, Homo Sapiens
  Muscle
  sig_peptide 89..271: Von Heijne matrix
  score 3.90
  misc_feature 44..169: seq YTAVSVLAGPRWA/DP; blastn; identity 100; region 1..126
  id AA094226
  misc_feature 170..231: est; blastn; identity 100; region 126..187
  id AA094226
  misc_feature 230..261: est; blastn; identity 96; region 185..216
  id AA094226
  misc_feature 44..195: est; blastn; identity 100; region 129..280
  id R13710
  misc_feature 193..254: est; blastn; identity 98; region 279..340
  id R13710
  misc_feature 44..282: est; blastn; identity 97; region 172..410
  id R54574
  misc_feature 44..184: est; blastn; identity 100; region 159..299
  id T78111
  misc_feature 182..222: est; blastn; identity 92; region 298..338
  id T78111
  misc_feature 220..254: est; blastn; identity 97; region 337..371; id T78111; est
gcggcgcggccgtaaagcgccattacgcagagagaaagttacgagaaactcgttttcatcttcttggtttcatcttaataccaacgtcatgtctggttctaatggttccaaagaaaattctcacaataaggctcggacgtctccttacccaggttcaaaagttgaacgaagccaggttcctaatgagaaagtgggctggcttgttgagtggcaagactataagcctgtggaatacactgcagtctctgtcttggctggacccaggtgggcagatcctcagatcagtgaaagtaatttttctcccaagtttaacgaaaaggatgggcatgttgagagaaagagcaagaatggcctgtat

SEQ ID NO: 1527 - DNA, 346 bp, Homo Sapiens
  Dystrophic muscle
  sig_peptide 284..331: Von Heijne matrix
  score 3.50
  misc_feature 294..347: seq TLMFSLTAQWXTS/RS; blastn; identity 94; region 297..350
  id AA038489
  misc_feature 134..347: est; blastn; identity 99; region 1..214
  id AA111922
  unsure -3: est; position -3 of amino acid sequence; Xaa = Phe,Ile
aaaaaaaagctgctggaccccagggagagctgaccactgcccgagcagccggctgaatccacctccacaatgcsgctctcaggaaccccggyccctaataagaagaggaaatccagcaagctgatcatggaactcactggaggtggacaggagagctcaggcttgaacctgggcaaaaagatcagtgtcccaagggatgtgatgttggaggaactgtcgctgcttaccaaccggggctccaagatgttcaaactgsggcagatgagggtggagaagtttatttatgagaaccaccctgatgttttctctgacagctcaatggwtcacttccagaagttccttccaa

SEQ ID NO: 1528 - DNA, 384 bp, Homo Sapiens
  kidney
  sig_peptide 73..147: Von Heijne matrix
  score 14.10
  misc_feature 35..384: seq LTLLLLLTLLAFA/GY; blastn; identity 98; region 8..357
  id H11129
  misc_feature 43..346: est; blastn; identity 99; region 16..319
  id R11829
  misc_feature 50..302: est; blastn; identity 99; region 1..253
  id R18811
  misc_feature 302..366: est; blastn; identity 96; region 254..318
  id R18811
  misc_feature 183..371: est; blastn; identity 96; region 6..194; id R10511; est
actgcgcggatcggcgtccgcagcgggcggctgctgagctgccttgaggtgcagtgttggggatccagagccatgtcggacctgctactactgggcctgattgggggcctgactctcttactgctgctgacgctgctggcctttgccgggtactcagggctactggctggggtggaagtgagtgctgggtcaccccccatccgcaacgtcactgtggcctacaagttccacatggggctctatggtgagactgggcggcttttcactgagagctgcagcatctctcccaagctccgctccatcgctgtctactatgacaacccccacatggtgccccctgataagtgccgatgtgccgtgggcagcatcctgagtgaaggtgag

SEQ ID NO: 1529 - DNA, 269 bp, Homo Sapiens
  Dystrophic muscle
  sig_peptide 36..131: Von Heijne matrix
  score 11.40
  misc_feature 75..218: seq LWSLALWLPLALS/VS; blastn; identity 97; region 29..172
  id T64530
  unsure -18: est; position -18 of amino acid sequence; Xaa = Gln,Arg
aatccggactgataaccagccggccagactgagggatggaaggcactgagatgggggcccgtccaggcggacacccgcrgaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatctkgggacacgcggg

SEQ ID NO: 1530 - DNA, 395 bp, Homo Sapiens
  kidney
  sig_peptide 138..302: Von Heijne matrix
  score 11.20
  misc_feature 220..396: seq LLFALGSLGLIFA/LI; blastn; identity 98; region 207..383
  id N28787
  misc_feature 108..207: est; blastn; identity 93; region 95..194
  id N28787
  misc_feature 220..316: est; blastn; identity 97; region 209..305
  id AA019783
  misc_feature 108..207: est; blastn; identity 92; region 97..196
  id AA019783
  misc_feature 307..392: est; blastn; identity 91; region 297..382
  id AA019783
  misc_feature 108..207: est; blastn; identity 92; region 99..198
  id H86396
  misc_feature 307..374: est; blastn; identity 95; region 300..367
  id H86396
  misc_feature 255..313: est; blastn; identity 96; region 247..305
  id H86396
  misc_feature 220..336: est; blastn; identity 95; region 210..326
  id H86516
  misc_feature 108..207: est; blastn; identity 93; region 98..197
  id H86516
  misc_feature 327..368: est; blastn; identity 92; region 318..359
  id H86516
  misc_feature 108..207: est; blastn; identity 92; region 111..210
  id AA059290
  misc_feature 272..354: est; blastn; identity 92; region 285..367
  id AA059290
  misc_feature 220..286: est; blastn; identity 91; region 223..289
  id AA059290
  est
  misc_feature 95,99,132,161: n=a, g, c or t
  unsure -54: position -54 of amino acid sequence
  unsure -48: Xaa = Ala,Pro,Thr
  position -48 of amino acid sequence
  unsure -20: Xaa =  * ,Ser,Tyr
  position -20 of amino acid sequence
  unsure 5: Xaa = His,Pro
  position 5 of amino acid sequence
  unsure 22: Xaa = Arg,Ser; position 22 of amino acid sequence; Xaa = Ala,Glu
arcggttagtggaccgggaccggtavgggtgctgtwgccatcatggctgaccccgmmccccggbacmctcgctcctcgatcgaggacgacttcanmtmnggcaggcaagcgtggcctccgccaccgtgymbntccgaatgvcctttctgagaaaagtctmnagcattctttctctgcaggttctcttaactacagtgacttcaacagtttttttatactttgagtctgtacggacatttgtacmtgagagtcctgccttaattttgctgtttgccctcggatctctgggtttgatttttgcgttgattttaaacagvcataagtatccccttaacctgtacctactttttggatttacgctgttggmagctctgactgtggcagttgttgttact

SEQ ID NO: 1531 - DNA, 156 bp, Homo Sapiens
  Muscle
  sig_peptide 22..135: Von Heijne matrix
  score 10.80
  misc_feature 53..155: seq MLLLLLLLGSGQG/PQ; blastn; identity 100; region 24..126
  id AA075942
  misc_feature 66..136: est; blastn; identity 100; region 37..107; id AA262924; est
aaagggtcgttggtgggaaagatggcggcgactctgggaccccttgggtcgtggcagcagtggcggcgatgtttgtcggctcgggatgggtccaggatgttactccttcttcttttgttggggtctgggcaggggccacagcaagtcggggcgggg

SEQ ID NO: 1532 - DNA, 353 bp, Homo Sapiens
  kidney
  sig_peptide 195..317: Von Heijne matrix
  score 9.90
  misc_feature complement(64..95): seq ILPFLLFPFPVNA/RS; blastn; identity 90; region 79..110
  id N98118
  unsure 4: est; position 4 of amino acid sequence; Xaa = Leu,Ser
atagtgatccttttccttctcccactccgtaagtttctatccttggcctcctattctttttactacatatatactttatatatacatatatacttggaacaggcttaatgagttccaaggtttcaagtataatagaaggatagtttccctaatatttcttcaaaacagatttctcttctgaaatccagagtcatatgtccagttggatgtatcttggataccccattgtcacctcaaacactacttgtctaaaactgatctcatcatcttttccccaaatccttccttttcttctatttcccttcccagtgaatgccagatctcactyagttgctcaaactaaaagcccgagg

SEQ ID NO: 1533 - DNA, 159 bp, Homo Sapiens
  Dystrophic muscle
  sig_peptide 46..108: Von Heijne matrix
  score 9.70
  misc_feature 88..132: seq QLCLLLLPSCSLS/VS; blastn; identity 100; region 352..396; id AA021024; est
acctcttggggcctactttgggatgaagtrgcctccctcagcagcatggcccctggggtcatcatcatccagctctgcctcttgctcctgccttcctgctccctttctgtttccggatgttcctgccctagtgcctgcttcagcaccaccagccgcgag

SEQ ID NO: 1534 - DNA, 428 bp, Homo Sapiens
  kidney
  sig_peptide 99..377: Von Heijne matrix
  score 9.60
  misc_feature 283..322: seq LSLSLGASAPVQC/QQ; blastn; identity 90; region 179..218
  id N78639
  misc_feature 283..322: est; blastn; identity 90; region 193..232
  id AA150442
  est
  misc_feature 403..404: n=a, g, c or t
  unsure -77: position -77 of amino acid sequence
  unsure -76: Xaa = His,Asn
  position -76 of amino acid sequence
  unsure -75: Xaa = Leu,Val
  position -75 of amino acid sequence
  unsure -74: Xaa =  * ,Lys,Arg,Trp
  position -74 of amino acid sequence
  unsure -69: Xaa = Ala,Pro
  position -69 of amino acid sequence
  unsure -68: Xaa = Ala,Cys,Gly,Ser
  position -68 of amino acid sequence
  unsure 9: Xaa = Ala,Gly; position 9 of amino acid sequence; Xaa =  * ,Ala,Cys,Asp,Glu,Phe,Gly,Leu,Ser,Val,Trp,Tyr
acatgctcagggtcaggttccagccccagctgagggctgaggggagtgggtggacatggggcagggagctggaagaacactcgagagacagcaggtagatgagacatggctttattcagcagcagttttcattaacagctttctcamacsttwrgscwatcttcacactgkstgscctgtctcagttgcttagttcagcagctcccaaacacacagctgcaccgacggccctcccttgccttcagggtcagcagcttaactctctctctctgggcacaagtgagctgagctgtgtcctggcttcctcctgtctatctacaaagacagacccctctggtctctctctctctttgggtgccagcgcacctgtacagtgtcagcaggacaattataccttttgcknncaatactggcttagagcaaggcat

SEQ ID NO: 1535 - DNA, 370 bp, Homo Sapiens
  kidney
  sig_peptide 140..262: Von Heijne matrix
  score 9.50
  misc_feature 325..371: seq LIIFLSFLPFINS/SF; blastn; identity 95; region 277..323
  id AA015589
  misc_feature 325..371: est; blastn; identity 95; region 277..323
  id AA019963
  unsure 26: est
  position 26 of amino acid sequence
  unsure 27: Xaa = Glu,Gly; position 27 of amino acid sequence; Xaa = Ser,Thr
acaagtgggataggtcctgtgacagaattgtgtgatacaggtcaaacaggagttgggttatggggaaaatgccagttgaaatatgttttgatctttggagaaacctattttttcatttaacctgttctttaaatccagtatgttccagaacatacaaaaatgtttaaatgttccatttgtaagaggatatcatgtattttatatcaatttaaatgcagttatcctaatcatttttctttcatttttaccctttattaactcttcatttgtttacaaaacaaatccactctatgacgcaatctctaattatgtgttttctttcaggtatccaaaccttgraasctttgctctagatgtcaggcttgttttt

SEQ ID NO: 1536 - DNA, 361 bp, Homo Sapiens
  kidney
  sig_peptide 281..340: Von Heijne matrix
  score 9.20
  misc_feature complement(215..358): seq FPVLALFLSGSLA/LF; blastn; identity 97; region 165..308
  id R98055
  misc_feature 185..289: est; blastn; identity 97; region 252..356
  id W23510
  misc_feature 136..186: est; blastn; identity 98; region 202..252
  id W23510
  misc_feature 73..109: est; blastn; identity 97; region 139..175
  id W23510
  misc_feature 315..352: est; blastn; identity 92; region 385..422
  id W23510
  misc_feature complement(215..358): est; blastn; identity 97; region 144..287
  id T46976
  misc_feature complement(227..358): est; blastn; identity 99; region 167..298
  id AA084768
  misc_feature complement(248..358): est; blastn; identity 97; region 169..279
  id R50108
  misc_feature complement(215..250): est; blastn; identity 94; region 278..313; id R50108; est
agagtgagacgggcagatggaggagggattgtaatggcggyagcggcagctcccstgctctgacccacggcaggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatacctctggg

SEQ ID NO: 1537 - DNA, 268 bp, Homo Sapiens
  kidney
  sig_peptide 59..145: Von Heijne matrix
  score 8.90
  misc_feature 19..132: seq ALLIVCDVPSASA/QR; blastn; identity 99; region 1..114
  id N87112
  misc_feature 194..267: est; blastn; identity 94; region 174..247
  id N87112
  misc_feature 130..195: est; blastn; identity 98; region 111..176
  id N87112
  misc_feature 68..267: est; blastn; identity 99; region 1..200
  id T68050
  misc_feature 63..209: est; blastn; identity 95; region 1..147
  id AA157180
  misc_feature 66..195: est; blastn; identity 98; region 1..130
  id AA094982
  misc_feature 190..264: est; blastn; identity 97; region 5..79
  id W00395
  est
  misc_feature 259: n=a, g, c or t
  unsure 38: position 38 of amino acid sequence; Xaa = Ala,Asp,Glu
acccaccctcagacctagccggagcaaagtttcacttatagaagggagagaagcgaacatggcagcgcgttggcggttttggtgtgtctctgtgaccatggtggtggcgctgctcatcgtttgcgacgttccctcagcctctgcccaaagaaagaaggagatggtgttatctgaaaaggttagtcagctgatggaatggactaacaaaagacctgtaataagaatgaatggagacaagttccgtcgccttgtgaaagmnccaccgagg

SEQ ID NO: 1538 - DNA, 328 bp, Homo Sapiens
  kidney
  sig_peptide 191..286: Von Heijne matrix
  score 8.80
  misc_feature 131..327: seq VPMLLLIVGGSFG/LR; blastn; identity 98; region 45..241
  id H81225
  misc_feature 86..123: est; blastn; identity 100; region 1..38
  id H81225
  misc_feature 121..327: est; blastn; identity 98; region 2..208
  id W01412
  misc_feature 129..327: est; blastn; identity 98; region 1..199
  id AA044118
  misc_feature 131..327: est; blastn; identity 98; region 13..209
  id W42797
  misc_feature 209..327: est; blastn; identity 97; region 95..213
  id R39635
  misc_feature 130..209: est; blastn; identity 98; region 15..94
  id R39635
  est
  misc_feature 303: n=a, g, c or t
  unsure 6: position 6 of amino acid sequence; Xaa = Leu,Pro,Gln,Arg
aacaagtatgttacgatggctcgattgcttttgcctagcggaaaccattcactaaggaccgagcaccaaataaccaaggaaaaggaagtgagttaaggacgtactcgtcttggtgagagcgtgagctgctgagatttgggagtctgcgctaggcccgcttggagttctgagccgatggaagagttcactcatgtttgcacccgcggtgatgcgtgcttttcgcaagaacaagactctcggctatggagtccccatgttgttgctgattgttggaggttcttttggtcttcgtgagttttctcnaatccgatatgatgctgtgaagggg

SEQ ID NO: 1539 - DNA, 378 bp, Homo Sapiens
  Kidney
  sig_peptide 70..180: Von Heijne matrix
  score 8.50
  misc_feature 106..210: seq LLVLLLYAPVGFC/LL; blastn; identity 97; region 104..208
  id AA131932
  misc_feature 298..342: est; blastn; identity 95; region 293..337
  id AA131932
  misc_feature 86..291: est; blastn; identity 95; region 67..272
  id AA001989
  misc_feature 29..102: est; blastn; identity 93; region 11..84
  id AA001989
  misc_feature 102..331: est; blastn; identity 96; region 76..305
  id W32996
  misc_feature 55..96: est; blastn; identity 97; region 31..72
  id W32996
  misc_feature 236..377: est; blastn; identity 98; region 165..306
  id AA121218
  misc_feature 106..235: est; blastn; identity 99; region 34..163
  id AA121218
  est
  misc_feature 48: n=a, g, c or t
  unsure 5: position 5 of amino acid sequence; Xaa = Gly,Arg
aagagcssctgcggccgggcgcgaaaatggcggcggcggcgacggccnggcgctcctgaagcagcagttatggagcttccctcagggccggggccggagcggctctttgactcgcaccggcttccgggtgactgcttcctactgctcgtgctgctgctctacgcgccagtcgggttctgcctcctcgtcctgsgcctctttctcgggatccacgtcttcctggtcagctgcgcgctgccagacagcgtccttcgcagattcgtagtgcggaccatgtgtgcggtgctagggctcgtggcccggcaggaggactccggactccgggatcacagtgtcagggtcctcatttccaaccatgtgacacctttcgaccaccag

SEQ ID NO: 1540 - DNA, 381 bp, Homo Sapiens
  kidney
  sig_peptide 106..375: Von Heijne matrix
  score 8.40
  misc_feature 38..181: seq SLVLLTVTPSXRQ/QE; blastn; identity 97; region 1..144
  id W60505
  misc_feature 186..312: est; blastn; identity 93; region 150..276
  id W60505
  misc_feature 305..346: est; blastn; identity 100; region 270..311
  id W60505
  misc_feature 38..312: est; blastn; identity 94; region 1..275
  id W60589
  misc_feature 305..346: est; blastn; identity 100; region 269..310
  id W60589
  misc_feature 32..175: est; blastn; identity 97; region 1..144
  id R33763
  misc_feature 176..261: est; blastn; identity 96; region 144..229
  id R33763
  misc_feature 268..312: est; blastn; identity 91; region 238..282
  id R33763
  misc_feature 305..337: est; blastn; identity 93; region 276..308
  id R33763
  misc_feature 33..176: est; blastn; identity 90; region 3..146
  id AA123856
  misc_feature 181..346: est; blastn; identity 90; region 88..253
  id HSB31E112
  misc_feature 93..181: est; blastn; identity 95; region 1..89
  id HSB31E112
  est
  misc_feature 265: n=a, g, c or t
  unsure -82: position -82 of amino acid sequence
  unsure -79: Xaa = Glu,Lys
  position -79 of amino acid sequence
  unsure -37: Xaa = Phe,Val
  position -37 of amino acid sequence
  unsure -31: Xaa =  * ,Glu,Lys,Gln
  position -31 of amino acid sequence
  unsure -30: Xaa = Asp,Glu,Gly,His,Leu,Gln,Arg,Val
  position -30 of amino acid sequence
  unsure -3: Xaa = Leu,Met,Val; position -3 of amino acid sequence; Xaa = Ser,Thr
aggacttcccccgggctgagctgcgcasggggttttggccaaattgggcgagggcacaaaataaccacttaccccttctcaccgaggaagagcgggagaaagggtatggcacagtcacaagggtgggtgraaagrtacktcaaggccttttgtaaaggcttctttgtggcggtgcctgtggcagtgactttcttggatcgggtcgcctgtgtggcaagagtagaaggagcatcgatgcagccttctttgaatcctggggggagcnagtcatctgatgtggtgsdddtgaaccactggaaagtgaggaattttgaagtacaccgtggtgacattgtatcattggtgttgctcactgtgacgccctccasccgacaacaggag

SEQ ID NO: 1541 - DNA, 321 bp, Homo Sapiens
  kidney
  sig_peptide 67..135: Von Heijne matrix
  score 8.10
  misc_feature 11..158: seq WLLVLSFVFGCNV/LR; blastn; identity 93; region 11..158
  id H56585
  misc_feature 201..322: est; blastn; identity 97; region 201..322
  id H56585
  misc_feature 151..322: est; blastn; identity 93; region 119..290
  id AA147898
  misc_feature 39..159: est; blastn; identity 95; region 8..128
  id AA147898
  misc_feature 201..322: est; blastn; identity 98; region 83..204
  id R52248
  misc_feature 170..202: est; blastn; identity 93; region 51..83
  id R52248
  misc_feature 177..264: est; blastn; identity 94; region 87..174
  id H54950
  misc_feature 284..315: est; blastn; identity 96; region 192..223
  id H54950
  misc_feature complement(199..320): est; blastn; identity 95; region 40..161
  id W22146
  est
  misc_feature 294: n=a, g, c or t
  unsure 5: position 5 of amino acid sequence
  unsure 7: Xaa = Leu,Arg
  position 7 of amino acid sequence
  unsure 8: Xaa = Ala,Gly,Val
  position 8 of amino acid sequence
  unsure 9,11: Xaa = Phe,Leu
  position 9, 11 of amino acid sequence
  unsure 12: Xaa = Leu,Val
  position 12 of amino acid sequence
  unsure 22: Xaa = His,Gln
  position 22 of amino acid sequence
  unsure 53: Xaa = Glu,Gln; position 53 of amino acid sequence; Xaa = Asp,Glu
agccgctgttgttgtggtccccatggagctgccgtagcggacccagcacagccaggagcgtccgggatgagctcagccgcggccgaccactgggcgtggttgctggtgctcagcttcgtgtttggatgcaatgttcttaggatcctcckcccggbcytcstmatcstgcakgtccagggtgctgcagaaggacgcggasaggagtcacagatgagagcggagatccaggacatgaagcaggagctctccacagtcaacatgatggacgagtttgccagatatgccaggctgganagaaagatcaacaagatgacggataag

SEQ ID NO: 1542 - DNA, 382 bp, Homo Sapiens
  kidney
  sig_peptide 281..340: Von Heijne matrix
  score 8.00
  misc_feature 196..382: seq HVFFLLLLAHIIA/LE; blastn; identity 98; region 10..196
  id HSC2EA121
  misc_feature 121..205: est; blastn; identity 100; region 134..218
  id AA095017
  misc_feature 197..252: est; blastn; identity 92; region 209..264; id AA095017; est
gtttttgtttgtgtgtgcgtgttgttggcctccatccccactccccagactccacttctccaggcctctctcccgccttttcatcccgcatccgcaggacacccaatcaccggggcaacaggatgccttccgcgccttccaccctgacctggaattcgtgggcaagttcttgaaacccctgctgattggtgaactggccccggaggagcccagccaggaccacggcaagaactcaaagatcactgaggacttccgggccctgaggaagacggctgaggacatgaacctgttcaagaccaaccacgtgttcttcctcctcctcctggcccacatcatcgccctggagagcattgcatggttcactgtcttttactttggcaat

SEQ ID NO: 1543 - DNA, 298 bp, Homo Sapiens
  Dystrophic muscle
  sig_peptide 170..241: Von Heijne matrix
  score 7.90
  misc_feature 80..300: seq LLLPRVLLTMASG/SP; blastn; identity 100; region 101..321
  id H21228
  misc_feature 60..300: est; blastn; identity 100; region 117..357
  id R72127
  misc_feature 19..59: est; blastn; identity 100; region 77..117
  id R72127
  misc_feature 60..204: est; blastn; identity 97; region 63..207
  id H18908
  misc_feature 195..269: est; blastn; identity 100; region 199..273
  id H18908
  misc_feature 19..59: est; blastn; identity 100; region 23..63
  id H18908
  misc_feature 65..203: est; blastn; identity 95; region 144..282
  id W93461
  misc_feature 19..59: est; blastn; identity 100; region 98..138
  id W93461
  misc_feature 252..288: est; blastn; identity 97; region 333..369
  id W93461
  misc_feature 228..259: est; blastn; identity 90; region 308..339
  id W93461
  misc_feature 136..300: est; blastn; identity 98; region 93..257; id HUM085F04B; est
aatcacgtggctgccacccaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggc

SEQ ID NO: 1544 - DNA, 288 bp, Homo Sapiens
  kidney
  sig_peptide 1..198: Von Heijne matrix
  score 7.90
  misc_feature 1..286: seq LLLPRVLLTMASG/SP; blastn; identity 99; region 1..286
  id HUM085F04B
  misc_feature 147..245: est; blastn; identity 97; region 167..265
  id R64509
  misc_feature 99..161: est; blastn; identity 93; region 118..180
  id R64509
  misc_feature 245..286: est; blastn; identity 100; region 266..307
  id R64509
  misc_feature 147..262: est; blastn; identity 98; region 182..297
  id H85714
  misc_feature 99..161: est; blastn; identity 93; region 133..195
  id H85714
  misc_feature 95..286: est; blastn; identity 99; region 159..350
  id H21228
  misc_feature 201..286: est; blastn; identity 96; region 151..236
  id AA009893
  misc_feature 148..206: est; blastn; identity 98; region 97..155
  id AA009893
  misc_feature 99..160: est; blastn; identity 91; region 49..110; id AA009893; est
atgatagggtcgggattggctggctctggaggcgcaggtggtccttcttctactgtcacatggtgcgcgctgttttctaatcacgtggctgcmacccaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccagg

SEQ ID NO: 1545 - DNA, 322 bp, Homo Sapiens
  kidney
  sig_peptide 11..82: Von Heijne matrix
  score 7.90
  misc_feature 32..319: seq LLLPRVLLTMASG/SP; blastn; identity 99; region 53..340
  id AA056366
  misc_feature 32..319: est; blastn; identity 99; region 80..367
  id R77008
  misc_feature 32..223: est; blastn; identity 98; region 77..268
  id W75983
  misc_feature 223..319: est; blastn; identity 98; region 269..365
  id W75983
  misc_feature 32..223: est; blastn; identity 98; region 129..320
  id W39055
  misc_feature 223..319: est; blastn; identity 98; region 321..417
  id W39055
  misc_feature 32..236: est; blastn; identity 98; region 84..288
  id N48534
  misc_feature 264..319: est; blastn; identity 92; region 318..373
  id N48534
  unsure 65: est; position 65 of amino acid sequence; Xaa = Lys,Met,Thr
atttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccagggccgtggtggagaagcgcctagcagcctgcgtcaacctcatccctcagattacatccatctatgagtggaaagggahgatcgaggaagacagtgaggtgctgatgatgattaaaacccaagcg

SEQ ID NO: 1546 - DNA, 395 bp, Homo Sapiens
  kidney
  sig_peptide 33..308: Von Heijne matrix
  score 7.60
  misc_feature 138..193: seq FLLLTVALLASYS/VH; blastn; identity 100; region 247..302; id T80036; est
aagatggaactggtagtcagctggagagcagcatggaggcgtcctgggggagcttcaacgctgagcggggctggtatgtctctgtgcagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttatggctaataccggtgtctttggatttagcttcttgctgctgacagttgctctcctggcttcttactcagtccatcttctgcttagtatgtgtattcagacagctgtaacatcttatgaagatcttggactctttgcatttggattacctggactg

SEQ ID NO: 1547 - DNA, 134 bp, Homo Sapiens
  Heart
  sig_peptide 78..128: Von Heijne matrix
  score 7.60
  misc_feature 18..132: seq FFLLLRFFLRIDG/VP; blastn; identity 95; region 1..115; id T10447; est
attttgaagaagttctcctttttgaggatgaacttcatgatcatggagtttcaagcctgagtgtgaagattagagtaatgccttctagctttttcctgctgttgcggtttttcttgagaattgacggggtgccg

SEQ ID NO: 1548 - DNA, 337 bp, Homo Sapiens
  Dystrophic muscle
  sig_peptide 200..256: Von Heijne matrix
  score 7.60
  misc_feature 44..276: seq FIVGIYFLSSCRA/EE; blastn; identity 98; region 1..233
  id N83601
  misc_feature 51..276: est; blastn; identity 92; region 15..240
  id N56180
  misc_feature 69..216: est; blastn; identity 95; region 23..170
  id R57553
  misc_feature 46..75: est; blastn; identity 96; region 1..30
  id R57553
  misc_feature 58..142: est; blastn; identity 98; region 42..126
  id R57171
  misc_feature 18..56: est; blastn; identity 94; region 1..39
  id R57171
  misc_feature 142..182: est; blastn; identity 95; region 97..137
  id N88966
  misc_feature 49..83: est; blastn; identity 100; region 1..35; id N88966; est
agtctttgtcctgagcccacgattccagagctggctggacccaaggaggtgaagagtcacttttcagccccaggaagggcaaagaagagagaraatcagcctgtctgctctctccttggctcaacaaggcctctaacagtcttctgtcctctattctgcacacggcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggtttta

SEQ ID NO: 1549 - DNA, 327 bp, Homo Sapiens
  Muscle
  sig_peptide 145..213: Von Heijne matrix
  score 7.40
  misc_feature 98..223: seq VLLLAALPPVLLP/GA; blastn; identity 97; region 57..182
  id AA019348
  misc_feature 215..329: est; blastn; identity 98; region 173..287
  id AA019348
  misc_feature 43..98: est; blastn; identity 96; region 1..56
  id AA019348
  misc_feature 98..217: est; blastn; identity 99; region 57..176
  id AA013099
  misc_feature 211..329: est; blastn; identity 97; region 171..289
  id AA013099
  misc_feature 43..98: est; blastn; identity 96; region 1..56
  id AA013099
  misc_feature 215..319: est; blastn; identity 98; region 130..234
  id R54717
  misc_feature 142..223: est; blastn; identity 95; region 58..139
  id R54717
  misc_feature 95..149: est; blastn; identity 92; region 10..64
  id R54717
  misc_feature 105..173: est; blastn; identity 98; region 1..69
  id AA112675
  misc_feature 215..267: est; blastn; identity 92; region 108..160
  id AA112675
  misc_feature 296..329: est; blastn; identity 94; region 185..218
  id AA112675
  misc_feature 167..196: est; blastn; identity 93; region 62..91
  id AA112675
  misc_feature 88..223: est; blastn; identity 91; region 3..138
  id H27167
  misc_feature 215..319: est; blastn; identity 98; region 129..233
  id H27167
  unsure 32: est; position 32 of amino acid sequence; Xaa = Glu,Lys
agagtgttcgccgccgccgcggccgccacctggagtttcttcagactccagatttccctgtcaaccacgaggagtccagagaggaaacgcggaggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgraggcctcgctggagatcgag

SEQ ID NO: 1550 - DNA, 476 bp, Homo Sapiens
  kidney
  sig_peptide 306..416: Von Heijne matrix
  score 7.30
  misc_feature 166..415: seq LLSACLVTLWGLG/EP; blastn; identity 96; region 1..250
  id HSU52870
  misc_feature 182..337: est; blastn; identity 94; region 156..311
  id T35951
  misc_feature 32..132: est; blastn; identity 96; region 7..107
  id T35951
  misc_feature 136..193: est; blastn; identity 96; region 109..166
  id T35951
  misc_feature 182..328: est; blastn; identity 92; region 156..302
  id T35949
  misc_feature 32..132: est; blastn; identity 96; region 7..107
  id T35949
  misc_feature 136..193: est; blastn; identity 94; region 109..166
  id T35949
  misc_feature 233..409: est; blastn; identity 96; region 53..229
  id W17267
  misc_feature 401..476: est; blastn; identity 96; region 220..295
  id W17267
  misc_feature 182..399: est; blastn; identity 96; region 54..271
  id HSC34G011
  misc_feature 136..192: est; blastn; identity 96; region 7..63
  id HSC34G011
  est
  misc_feature 304: n=a, g, c or t
  unsure 13: position 13 of amino acid sequence; Xaa = His,Gln
aattcatttttcactcctccctcctaggtcacacttttcagaaaaagaatctgcatcctggaaaccagaagaaaaatatgagacggggaatcatcgtgtgatgtgtgtgctgcctttggctkwgtgtgtkgaagtycckgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcadvngatgccccactccagcctgcatccatccatcccgtgtcccaggggtcacggggcccagaaggcagccttggttctgctgagtgcctgcctggtgaccctttgggggctaggagagccaccagagcacactctccggtacctggtgctccamctagcctccctgcagctggga

SEQ ID NO: 1551 - DNA, 220 bp, Homo Sapiens
  Dystrophic muscle
  sig_peptide 59..145: Von Heijne matrix
  score 7.30
  misc_feature complement(28..221): seq HLLLLLLPAPTLK/GL; blastn; identity 98; region 32..225
  id AA025879
  misc_feature complement(1..154): est; blastn; identity 98; region 97..250
  id N33067
  misc_feature complement(144..221): est; blastn; identity 94; region 31..108
  id N33067
  misc_feature complement(1..221): est; blastn; identity 98; region 31..251
  id AA132495
  misc_feature complement(1..221): est; blastn; identity 98; region 31..251
  id AA063545
  misc_feature complement(28..221): est; blastn; identity 98; region 47..240; id N99132; est
acactcgggccccactcaaggatgtagggccttttctggcccctgacccctccctggcatgggagcgtggggacggggctggccttgggaggagcggcaggggcatcacctccttctgctgcttctccctgctcctaccctcaagggcctgggggctgcccagctgcctctatgcccttctgggggtctcagcccactgctgacacttctgcaatccggg

SEQ ID NO: 1552 - DNA, 428 bp, Homo Sapiens
  kidney
  sig_peptide 57..281: Von Heijne matrix
  score 7.20
  misc_feature 56..429: seq LLFIIGLIGCCAT/IR; blastn; identity 98; region 65..438
  id W27019
  misc_feature complement(79..429): est; blastn; identity 99; region 91..441
  id W26783
  misc_feature 284..390: est; blastn; identity 92; region 343..449; id W85233; est
actctcggtgagcgcrscccgctctccgggccgggtcttcgcgggccaccggcgccatgggccagtgcggcatcacctcctccaagaccgtgctggtctttctcaacctcatcttctggggggcagctggcattttatgctatgtgggagcctatgtcttcatcacttatgatgactatgaccacttctttgaagatgtgtacacgctcatccctgctgtagtgatcatagctgtaagagccctgcttttcatcattgggctaattggctgctgtgccacaatccgggaaagtcgctgtggacttgccacgtttgtcatcatcctgctcttggtttttgtcacagaagttgttgtagtggttttgggatatgtttacagagcaaaggtggaaaatgaggttgatcgcagcattcagaaagtgtataag

SEQ ID NO: 1553 - DNA, 425 bp, Homo Sapiens
  kidney
  sig_peptide 81..275: Von Heijne matrix
  score 7.00
  misc_feature 167..425: seq IGHFLCLVILVYC/AE; blastn; identity 97; region 106..364
  id N39913
  misc_feature 63..170: est; blastn; identity 98; region 1..108
  id N39913
  misc_feature 61..188: est; blastn; identity 96; region 39..166
  id HUM527C01B
  misc_feature 188..303: est; blastn; identity 94; region 165..280
  id HUM527C01B
  misc_feature 24..61: est; blastn; identity 100; region 1..38
  id HUM527C01B
  unsure -63: est
  position -63 of amino acid sequence
  unsure 17: Xaa = Ala,Ser; position 17 of amino acid sequence; Xaa = Lys,Gln
aagaggatttggcgccctcctctgtggattctggccaggccgggttcggcggttgctgtgagagcgggcttcccaacaccatgccgkccgccttctctgtcagctctttccccgtcagcatcccagccgtgctcacgcagacggactggactgagccctggctcatggggctggccaccttccacgcgctctgcgtgctcctcacctgcttgtcctcccgaagctacagactacagatcgggcactttctgtgtctagtcatcttagtctactgtgctgaatacatcaatgaggcggctgcgatgaactggagattattttcgmaataccagtatttcgactccagggggatgttcatttctatagtattttcagccccactgctggtgaatgccatgatcattgtggttatgtgggtatggaag

SEQ ID NO: 1554 - DNA, 213 bp, Homo Sapiens
  kidney
  sig_peptide 136..177: Von Heijne matrix
  score 6.70
  misc_feature 133..165: seq LLLSLFFPLRISL/SP; blastn; identity 90; region 11..43; id HUM153A05B; est
atttttctccggtacagcctgggaacgtaggtcccgcgcctgtgataagtaaggttggattttctcttccctgaggtgaaggatgcccggragscctcggcaggaccgcgcggaaacgggccttctgcccaaaagatgctgcttctctccttattctttcccctcagaatctcgctgtctccttccaaccacctgtggtcggcatcctccggg

SEQ ID NO: 1555 - DNA, 321 bp, Homo Sapiens
  kidney
  sig_peptide 82..150: Von Heijne matrix
  score 6.60
  misc_feature 16..319: seq LILVLQLLLRIRR/NR; blastn; identity 98; region 1..304
  id HSC26A021
  misc_feature 17..174: est; blastn; identity 96; region 1..158
  id W07871
  misc_feature 205..319: est; blastn; identity 97; region 192..306
  id W07871
  misc_feature 174..203: est; blastn; identity 96; region 159..188
  id W07871
  misc_feature 169..305: est; blastn; identity 98; region 144..280
  id T75539
  misc_feature 64..172: est; blastn; identity 94; region 41..149
  id T75539
  misc_feature 175..319: est; blastn; identity 100; region 161..305
  id H94774
  misc_feature 24..165: est; blastn; identity 94; region 10..151
  id H94774
  misc_feature 228..319: est; blastn; identity 93; region 203..294
  id W89738
  misc_feature 43..102: est; blastn; identity 91; region 22..81
  id W89738
  unsure 7: est; position 7 of amino acid sequence; Xaa = Ala,Pro
actcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgcsccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcgg

SEQ ID NO: 1556 - DNA, 325 bp, Homo Sapiens
  kidney
  sig_peptide 128..250: Von Heijne matrix
  score 6.40
  misc_feature 2..88: seq ILGCSSVCQLCTG/RQ; blastn; identity 96; region 18..104
  id R56970
  est
  misc_feature 86,116: n=a, g, c or t
  unsure -38: position -38 of amino acid sequence
  unsure -37: Xaa = Phe,Leu
  position -37 of amino acid sequence
  unsure -21: Xaa =  * ,Gln; position -21 of amino acid sequence; Xaa = Leu,Arg
aggagttaagaaatgtcgttcttcagatttaaaaagaaaacctttactgaatcagctgagtgttaataatacgaatttccttktcntgccaatkcdrmyctgrddcagraratcsnwgaacagggwtatgtgtggattwyagttttctctgccttgcctacgactgtttctggttgttacctgttatcktttattattactccacaaagaaatacttggatgttcgtctgtttgtcagctctgcactgggagacaaattaactgccgtaacttaggcctttcgagtattctaagaattttcctgaaagtacagtttttctgtatc

SEQ ID NO: 1557 - DNA, 366 bp, Homo Sapiens
  kidney
  sig_peptide 10..228: Von Heijne matrix
  score 6.40
  misc_feature 140..316: seq ACCFLSAFSPTLT/KS; blastn; identity 98; region 176..352
  id W42809
  misc_feature 14..129: est; blastn; identity 97; region 50..165
  id W42809
  misc_feature 140..242: est; blastn; identity 97; region 116..218
  id N99674
  misc_feature 58..129: est; blastn; identity 100; region 34..105
  id N99674
  misc_feature 243..285: est; blastn; identity 100; region 218..260
  id N99674
  misc_feature 27..57: est; blastn; identity 100; region 2..32
  id N99674
  misc_feature 140..272: est; blastn; identity 96; region 78..210
  id R20073
  misc_feature 267..364: est; blastn; identity 96; region 206..303
  id R20073
  misc_feature 63..129: est; blastn; identity 100; region 1..67
  id R20073
  misc_feature 35..139: est; blastn; identity 98; region 1..105
  id N99685
  misc_feature 140..242: est; blastn; identity 97; region 105..207
  id N99685
  misc_feature 286..316: est; blastn; identity 100; region 251..281
  id N99685
  misc_feature 6..139: est; blastn; identity 98; region 1..134
  id AA154228
  misc_feature 140..206: est; blastn; identity 95; region 134..200
  id AA154228
  unsure -32: est
  position -32 of amino acid sequence
  unsure -30: Xaa = Gly,Val
  position -30 of amino acid sequence
  unsure -29: Xaa = Lys,Pro,Gln,Thr; position -29 of amino acid sequence; Xaa =  * ,Glu,Gly
ataataaaaatgaaccccgttacagagtcaccatcatgtctcttctcaccaccctctgaatctgcattagccagtcaactagccctttcagcgtcatgtgaccagcgcgccccattcagcttggctggtgtcgkttcammakracccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacaccccag

SEQ ID NO: 1558 - DNA, 114 bp, Homo Sapiens
  Dystrophic muscle
  sig_peptide 25..87: Von Heijne matrix
  score 6.30
  misc_feature 2..86: seq LGLSVLLTAATVA/GV; blastn; identity 96; region 8..92
  id AA070287
  misc_feature 15..80: est; blastn; identity 100; region 1..66
  id T10748
  misc_feature 22..88: est; blastn; identity 100; region 17..83
  id N67981
  misc_feature 21..85: est; blastn; identity 100; region 17..81; id AA069568; est
aaggccgcggccgccagcgtggggatgtctaggagctcgaaggtggtgctgggcctctcggtgctgctgacggcggccacagtggccggcgtacatgtgaagcagcagtgggac

SEQ ID NO: 1559 - DNA, 204 bp, Homo Sapiens
  Muscle
  sig_peptide 31..108: Von Heijne matrix
  score 6.30
  misc_feature 1..197: seq GVGLVTLLGLAVG/SY; blastn; identity 99; region 8..204
  id H10448
  misc_feature 5..197: est; blastn; identity 98; region 1..193
  id AA127134
  misc_feature 5..197: est; blastn; identity 98; region 1..193
  id HUML13653
  misc_feature 1..197: est; blastn; identity 95; region 9..205
  id HSC18H071
  misc_feature 34..197: est; blastn; identity 96; region 13..176; id AA194682; est
gtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccagtgaaaagtacctgctacgactgctagacaagacgacccccggg

SEQ ID NO: 1560 - DNA, 340 bp, Homo Sapiens
  Muscle
  sig_peptide 167..319: Von Heijne matrix
  score 6.20
  misc_feature 33..227: seq VLLLSSAXLVXXS/SP; blastn; identity 95; region 1..195
  id W00881
  est
  misc_feature 303,314: n=a, g, c or t
  unsure -43: position -43 of amino acid sequence
  unsure -31: Xaa = Cys,Phe,Gly,Leu,Val,Trp
  position -31 of amino acid sequence
  unsure -6: Xaa = Ala,Pro
  position -6 of amino acid sequence
  unsure -3: Xaa = His,Leu,Pro,Gln,Arg
  position -3 of amino acid sequence
  unsure -2: Xaa = Ala,Asp,Gly,His,Asn,Pro,Arg,Ser,Thr; position -2 of amino acid sequence; Xaa = Asp,His,Asn,Tyr
catttgctcttctcttaactcctacctgaaaaccccattcctaaattattcactatatttcagacttcttcactcttctccmaaaacctgaatcagcttgtgctgattttttcctatctgctatccctaaaaggactagaccttctttctatccttactcccctcaatgtatccatcttacctcttgattkkscctcccattccctcacagttcctgaaacagtgcscccccccgaccctaagcgacccctttctgcccctggccttgaggtcccttgacgtgctgctcctgtcttctgctcnbytagtbvvcnattcctctcccttggaattcatcaga

SEQ ID NO: 1561 - DNA, 368 bp, Homo Sapiens
  kidney
  sig_peptide 195..293: Von Heijne matrix
  score 6.20
  misc_feature 253..332: seq ILLLXTFQTWCLR/IS; blastn; identity 90; region 159..238
  id AA114672
  unsure -27: est
  position -27 of amino acid sequence
  unsure -19: Xaa = Asp,Glu
  position -19 of amino acid sequence
  unsure -9: Xaa = Ala,Thr
  position -9 of amino acid sequence
  unsure 10: Xaa =  * ,Leu,Gln
  position 10 of amino acid sequence
  unsure 12: Xaa = Ile,Lys
  position 12 of amino acid sequence
  unsure 17: Xaa = Asp,Gly; position 17 of amino acid sequence; Xaa = Pro,Arg,Thr
aggggtacctggtcgtcatggcaggcggtattgaccgaagagcttgrtgaggaagagcagctgctgagaaggcatcgcaaakagaagaaggagttgcaasccaaaattcagggcatgaagaatgctgttcccaagaatgacaatgaagaggdaggargcagctcaccgragatgtggccaagttggaaaaagawatggaacagaaacayagagasgaactggagcaattgaagctgrctactaaggagaataagattctgttgctgywaacatttcaaacttggtgcttgagaatcagccacctcggatatcaraagcacawaagagrcgggtgcctggatmsaaggagctctctgtgttgtccttgg

SEQ ID NO: 1562 - DNA, 398 bp, Homo Sapiens
  kidney
  sig_peptide 54..122: Von Heijne matrix
  score 5.90
  misc_feature complement(1..43): seq TLKFLTLLQKSNA/KR; blastn; identity 90; region 209..251
  id AA013573
  misc_feature complement(1..43): est; blastn; identity 90; region 153..195
  id AA014924
  unsure 3: est; position 3 of amino acid sequence; Xaa = Ala,Pro
agacgaagctcgatgaagatttagagagttccagtgaatccgatgtgagtctgatgatgacagcacctgttctagcagctcagactctgaagtttttgacgttattgcagaaatcaaacgcaaaaaggsccaaccttgaccgacttcatgatgaactttggtacaacgatccaggccagatgaatgatggaccactctgcaaatgcagcgcaaaggcaagacgcacaggaattaggcacagcatttatcctggagaagaggccatcaagccctgtcgtcctatgaccaacaatgctggcagacttttccactaccggatcacagtmtccccgcctacgaactttttaactgacaggccaactgttatagaatacgatgatcacgagtatatctttgaa

SEQ ID NO: 1563 - DNA, 359 bp, Homo Sapiens
  kidney
  sig_peptide 54..134: Von Heijne matrix
  score 5.90
  misc_feature 105..208: seq ALALAXAPDLAQA/PL; blastn; identity 97; region 81..184
  id N51797
  misc_feature 30..110: est; blastn; identity 97; region 7..87
  id N51797
  est
  misc_feature 333: n=a, g, c or t
  unsure -8: position -8 of amino acid sequence
  unsure 66: Xaa = Ile,Leu
  position 66 of amino acid sequence
  unsure 67: Xaa = Ile,Met; position 67 of amino acid sequence; Xaa = Phe,Ile,Leu,Val
agtgcagaaggttctgggaagtaggagaccccactggctttggtcccctaagaatggactctgctgcctgtgctgctgctgccacccctgttccagccctggctttggcchtagctccagacctagcacaagccccactggcactccctggcctgttaagcccatcttgccttctctcctctggacaagaagtaaatgggagtgaaagaggaacttgtctctggaggccctggctgtcttccacaaatgactccccaaggcagatgaggaagctggtggatttggctgctggtggggcaacggctgctgaggtcaccaaggctgaatccatrntccatcaccctgtcaggctcttctgg

SEQ ID NO: 1564 - DNA, 405 bp, Homo Sapiens
  kidney
  sig_peptide 64..135: Von Heijne matrix
  score 5.70
  misc_feature 2..304: seq ILGLLGLLGTLVA/ML; blastn; identity 96; region 15..317
  id T86266
  unsure 33: est; position 33 of amino acid sequence; Xaa = His,Tyr
aaagagcttcagcctgaagacaagggagcagtccctgaagacgcttctactgagaggtctgccatggcctctcttggcctccaacttgtgggctacatcctaggccttctggggcttttgggsacactggttgccatgctgctccccagctggaaaacaagttcttatgtcggtgccagcattgtgacagcagttggcttctccaagggcctctggatggaatgtgccacayacagcacaggcatcacccagtgtgacatctatagcacccttctgggcctgcccgctgacatccaggctgcccaggccatgatggtgacatccagtgcaatctcctccctggcctgcattatctctgtggtgggcatgagatgcacagtcttctgccaggaatcccgagccagg

SEQ ID NO: 1565 - DNA, 324 bp, Homo Sapiens
  kidney
  sig_peptide 160..231: Von Heijne matrix
  score 5.70
  misc_feature 98..326: seq ILGLLGLLGTLVA/ML; blastn; identity 100; region 15..243; id T86266; est
agctgcttgtggccacccacagacacttgtaaggaggagagaagtcagcctggcagagagactctgaaatgassgattagaggtgttcaaggragcaaagagcttcagcctgaagacaagggagcagtccctgaagacgcttctactgagaggtctgccatggcctctcttggcctccaacttgtgggctacatcctaggccttctggggcttttgggcacactggttgccatgctgctccccagctggaaaacaagttcttatgtcggtgccagcattgtgacagcagttggcttctccaagggcctctggatggaatgtgcc

SEQ ID NO: 1566 - DNA, 397 bp, Homo Sapiens
  kidney
  sig_peptide 272..325: Von Heijne matrix
  score 5.60
  misc_feature 95..260: seq LLCECLLLVAGYA/HD; blastn; identity 98; region 19..184
  id AA132585
  misc_feature 347..399: est; blastn; identity 100; region 2..54; id N57441; est
acgcagccgtcagccgaacaattcgatgacgaggcccaggaagcacgctgaaaccctgggcggcggcaagctgtgcgacctcttctgcggccggcctggactagctttatcgtcatctgggaaattgttaaaaatgcaaattcgcaagtttgagagccatggttccaagaaactgcataagcatacgaaataagttgcagcctcccgwcttataccctggtacttctagtctaaaacaggatttgactctactaatccagccttatacaggatgctgtgttctttgctcctttgtgaatgtctgttgctggtagctggttatgctcatgatgatgactggattgaccccacagacatgcttaactatgatgctgcttcaggaacaatgagaaaatct

SEQ ID NO: 1567 - DNA, 96 bp, Homo Sapiens
  kidney
  sig_peptide 22..87: Von Heijne matrix
  score 5.50
  misc_feature 1..42: seq LWYVCPCPSGAWM/VP; blastn; identity 90; region 14..55; id H32593; est
agacgctgcccttccgcagcgatggcatcccggctctgtggaggggccctctggtatgtgtgtccctgtccttctggggcgtggatggtkcctggg

SEQ ID NO: 1568 - DNA, 257 bp, Homo Sapiens
  Muscle
  sig_peptide 69..152: Von Heijne matrix
  score 5.50
  misc_feature 19..254: seq LGYLVLSEGAVLA/SS; blastn; identity 98; region 15..250
  id H23844
  misc_feature 25..254: est; blastn; identity 99; region 8..237
  id AA036876
  misc_feature 24..254: est; blastn; identity 97; region 21..251
  id H22656
  misc_feature 35..217: est; blastn; identity 98; region 1..183
  id W05714
  misc_feature 218..254: est; blastn; identity 100; region 183..219
  id W05714
  misc_feature 34..244: est; blastn; identity 99; region 1..211
  id AA100765
  unsure 12: est; position 12 of amino acid sequence; Xaa = Ala,Ser,Thr
acgtgaccggggcctgaagccggaagctacctatctggtagggagctcccccagcaccgaagactgcgatgacttctgcactgacccaggggctggagcgaatcccagaccagctcggctacctggtactgagtgaaggtgcagtgctggcgtcatctggggacctggagaatgatgagcaggcadccagtgccatctctgagctggtcagcacagcctgcggtttccggctgcaccgcggcatgaatgtgcccagg

SEQ ID NO: 1569 - DNA, 254 bp, Homo Sapiens
  kidney
  sig_peptide 24..149: Von Heijne matrix
  score 5.40
  misc_feature 9..248: seq ITGVILLAVGIWG/KV; blastn; identity 96; region 6..245
  id H64050
  misc_feature 15..248: est; blastn; identity 96; region 1..234
  id R17172
  misc_feature 14..248: est; blastn; identity 94; region 1..235
  id HSC15C081
  misc_feature 22..248: est; blastn; identity 96; region 1..227
  id AA149663
  misc_feature 43..248: est; blastn; identity 94; region 29..234
  id HSU46380
  est
  misc_feature 99: n=a, g, c or t
  unsure -19: position -19 of amino acid sequence
  unsure -17: Xaa = Asp,Tyr
  position -17 of amino acid sequence
  unsure -15: Xaa = Phe,Ile,Leu,Met,Val
  position -15 of amino acid sequence
  unsure 9: Xaa = Cys,Phe
  position 9 of amino acid sequence
  unsure 21: Xaa = Ala,Ser
  position 21 of amino acid sequence
  unsure 29: Xaa = Gly,Val; position 29 of amino acid sequence; Xaa = Ile,Met
aggtgcagggtctcgggctagtcatggcgtccccgtctcggagactgcagactaaaccagtcattacttgtttcaagagcgttctgctaatckacactntkatttkctggatcactggcgtkatccttcttgcagttggcatttggggcaaggtgagcctggagaattactttkckcttttaaatgagaaggccaccaatgtccccttcgkgctcattgctactggtaccgtcatkattcttttgggctaccgg

SEQ ID NO: 1570 - DNA, 231 bp, Homo Sapiens
  kidney
  sig_peptide 49..108: Von Heijne matrix
  score 5.30
  misc_feature 1..228: seq VLLGSGLTILSQP/LM; blastn; identity 97; region 19..246
  id HUMHG1206
  misc_feature 1..222: est; blastn; identity 98; region 1..222
  id C15962
  misc_feature 37..222: est; blastn; identity 95; region 35..220
  id HUM417F07B
  misc_feature 2..33: est; blastn; identity 100; region 1..32
  id HUM417F07B
  misc_feature 59..228: est; blastn; identity 95; region 18..187
  id AA139623
  misc_feature 94..178: est; blastn; identity 96; region 1..85
  id N88476
  misc_feature 177..228: est; blastn; identity 94; region 82..133
  id N88476
  est
  misc_feature 195,205: n=a, g, c or t
  unsure 29: position 29 of amino acid sequence
  unsure 30: Xaa =  * ,Cys,Trp
  position 30 of amino acid sequence
  unsure 33: Xaa =  * ,Gln; position 33 of amino acid sequence; Xaa = Cys,Gly,Arg,Ser
gtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgnyagcttcctngtctctttagttatgctcagcacggg

SEQ ID NO: 1571 - DNA, 190 bp, Homo Sapiens
  Kidney
  sig_peptide 98..157: Von Heijne matrix
  score 5.30
  misc_feature complement(2..185): seq ALIFGGFISLIGA/AF; blastn; identity 93; region 93..276
  id AA136898
  misc_feature 43..89: est; blastn; identity 93; region 30..76
  id W96077
  misc_feature 125..161: est; blastn; identity 97; region 110..146
  id W96077
  misc_feature 83..119: est; blastn; identity 94; region 69..105
  id W96077
  misc_feature 15..49: est; blastn; identity 91; region 1..35
  id W96077
  misc_feature 126..161: est; blastn; identity 97; region 129..164
  id N41630
  misc_feature 58..89: est; blastn; identity 93; region 63..94
  id N41630
  misc_feature 2..31: est; blastn; identity 96; region 7..36
  id N41630
  misc_feature 38..161: est; blastn; identity 94; region 19..142
  id AA043148
  misc_feature 121..185: est; blastn; identity 98; region 61..125
  id HUM430A04B
  misc_feature 60..119: est; blastn; identity 98; region 1..60; id HUM430A04B; est
aacctcttccgagcggggtcacggcccggccgtcggtaacctggtttccgagagtgccgggcggtcggcgggtcagggcagcccggggcctgacgccatgtcccggaacctgcgcaccgcgctcattttcggcggcttcatctccctgatcggcgccgccttctatcccatctacttccgaccccatggg

SEQ ID NO: 1572 - DNA, 274 bp, Homo Sapiens
  kidney
  sig_peptide 206..256: Von Heijne matrix
  score 5.10
  misc_feature complement(97..229): seq LWCFHLVVLSLYS/SV; blastn; identity 95; region 10..142
  id H62783
  misc_feature 80..218: est; blastn; identity 94; region 54..192
  id T71240
  misc_feature 148..221: est; blastn; identity 98; region 356..429
  id AA075451
  misc_feature 80..140: est; blastn; identity 95; region 288..348
  id AA075451
  misc_feature 135..222: est; blastn; identity 92; region 350..437
  id AA009954
  misc_feature 105..140: est; blastn; identity 94; region 319..354
  id AA009954
  misc_feature 148..216: est; blastn; identity 98; region 384..452
  id W15396
  misc_feature 80..117: est; blastn; identity 97; region 315..352; id W15396; est
atgagtgttgatgtttttctgcactagaaggcactatgttgaactattaaacttaccagcactttctttttccactccatagtttcattgtactgacaacctcagctggcatcatggaccatgaagaagcaagacgaaaacacacaggragggaaaatcctgggattctttttctagggatgtaatacatatatttacaaataaaatgcctcatggactctggtgcttccacttggtcgttttgagcctttacagcagtgtagccacagcccgg

SEQ ID NO: 1573 - DNA, 125 bp, Homo Sapiens
  kidney
  sig_peptide 21..62: Von Heijne matrix
  score 5.00
  misc_feature complement(2..124): seq SLVAVFLSCGLIS/KN; blastn; identity 100; region 104..226
  id W94087
  misc_feature 2..124: est; blastn; identity 100; region 12..134
  id R37206
  misc_feature 2..124: est; blastn; identity 100; region 19..141
  id N42384
  misc_feature complement(2..92): est; blastn; identity 96; region 177..267
  id H84930
  misc_feature complement(81..124): est; blastn; identity 93; region 144..187
  id H84930
  misc_feature complement(2..124): est; blastn; identity 99; region 148..270; id H82795; est
ataaattagcagtattagttatgagtttggttgcagtgttcttatcttgtgggctgatttccaaaaaccacatgctgctgaatttaccagggatcctcatacctcacaatgcaaaccacttactg

SEQ ID NO: 1574 - DNA, 152 bp, Homo Sapiens
  Kidney
  sig_peptide 27..98: Von Heijne matrix
  score 5.00
  misc_feature 2..85: seq GALAVGAVPVVLS/AM; blastn; identity 91; region 4..87
  id HUML1521
  misc_feature 85..120: est; blastn; identity 94; region 86..121
  id HUML1521
  misc_feature 89..148: est; blastn; identity 96; region 123..182
  id W52706
  misc_feature 34..84: est; blastn; identity 92; region 69..119
  id W52706
  misc_feature complement(75..148): est; blastn; identity 91; region 324..397
  id AA132959
  est
  misc_feature 8: n=a, g, c or t
aaagttgnsacccggacggcctcaccatgatgaaacgggcagctgctgctgcagtgggaggagccctggcagtgggggctgtgcccgtggtgctcagtgccatgggcttcactggggcaggaatcgccgcgtcctccatagcagcccatggg

SEQ ID NO: 1575 - DNA, 429 bp, Homo Sapiens
  kidney
  sig_peptide 19..261: Von Heijne matrix
  score 4.90
  misc_feature 232..430: seq LISFSWFANYIRA/GT; blastn; identity 97; region 14..212; id H14129; est
attgccttcattgccggcatggccgtcattgtggataaaccctggttctatgacatgaagaaagtttgggagggatatcccatacagagcactatcccttcccagtattggtactacatgattgaactttccttctactggtccctgctcttcagcattgcctctgatgtcaagcgaaaggatttcaaggaacagatcatccaccatgtggccaccatcattctcatcagcttttcctggtttgccaattacatccgagctgggactctaatcatggctctgcatgactcttccgattacctgctggagtcagccaagatgtttaactacgcgggatggaagaacacctgcaacaacatcttcaccgtcttcgccattgtttttatcatcacccgactggtcatcctgcccttctggatcctgcattgc

SEQ ID NO: 1576 - DNA, 268 bp, Homo Sapiens
  kidney
  sig_peptide 35..82: Von Heijne matrix
  score 4.80
  misc_feature 111..221: seq SLFIYIFLTCSNT/SP; blastn; identity 97; region 37..147; id T82645; est
atagtatctattgaaaaggaagcagtgtgtatctatgattatatctctgttcatctatatatttttgacatgtagcaacacctctccatcttatcaaggaactcaactcggtctgggtctccccagtgcccagtggtggcctttgacaggtaggaggatgcagtgctgcaggctattttgttttttgttacaaaactgtcttttcccttttcccctccacctgattcagcatgatccctgtgagctggttctcacaatctctgggact

SEQ ID NO: 1577 - DNA, 266 bp, Homo Sapiens
  kidney
  sig_peptide 9..104: Von Heijne matrix
  score 4.70
  misc_feature 9..250: seq LQMLLGFVGRSKS/GL; blastn; identity 98; region 7..248
  id HSC2OD111
  misc_feature 122..257: est; blastn; identity 97; region 1..136
  id T77096
  misc_feature 18..146: est; blastn; identity 95; region 19..147; id N32450; est
agaccaagatggcggcggagctggtggaggccaaaaacatggtgatgagttttcgagtctccgaccttcagatgctcctgggtttcgtgggccggagtaagagtggactgaagcacgagctcgtcaccagggccctccagctggtgcagtttgactgtagccctgagctgttcaagaagatcaaggagctgtacgagacccgctacgccaagaagaactcggagcctgccccacagccgcaccggcccctggaccccctgaccggg

SEQ ID NO: 1578 - DNA, 264 bp, Homo Sapiens
  kidney
  sig_peptide 64..243: Von Heijne matrix
  score 4.70
  misc_feature 10..105: seq VHALCPLSPLVTT/GC; blastn; identity 93; region 1..96
  id R05622
  misc_feature 24..92: est; blastn; identity 97; region 2..70
  id H94933
  unsure -54: est
  position -54 of amino acid sequence
  unsure -49: Xaa = Ala,Asp
  position -49 of amino acid sequence
  unsure -48: Xaa = Pro,Arg
  position -48 of amino acid sequence
  unsure -44: Xaa = Lys,Thr
  position -44 of amino acid sequence
  unsure -42: Xaa = Asp,Glu
  position -42 of amino acid sequence
  unsure -37: Xaa = Cys,Phe,Tyr
  position -37 of amino acid sequence
  unsure -32: Xaa = His,Pro,Arg; position -32 of amino acid sequence; Xaa = Ala,Thr
aactctccaaaaagcagagacagcaggaagaggggagtggaggcagcccattcacctggggaaatgactgggttgtcgatggmcggtggcggbagccsaamgggggaygtggasccgtdctactatggtaarcvtgggcccctgcgcrcccttcctgagccctcaggaccccttccaccaagcagcggcctctcccagccccaggtccatgctctgtgccccttatctcccctggttaccacgggctgctgcgggcaggctgcg

SEQ ID NO: 1579 - DNA, 465 bp, Homo Sapiens
  kidney
  sig_peptide 367..459: Von Heijne matrix
  score 4.60
  misc_feature 157..269: seq GLLGXGLXXXSLT/AG; blastn; identity 97; region 95..207
  id N41379
  misc_feature 62..173: est; blastn; identity 90; region 1..112
  id N41379
  misc_feature 275..319: est; blastn; identity 95; region 213..257
  id N41379
  misc_feature 8..173: est; blastn; identity 90; region 1..166
  id AA044371
  misc_feature 157..219: est; blastn; identity 98; region 149..211
  id AA044371
  misc_feature complement(272..319): est; blastn; identity 93; region 423..470
  id N30852
  misc_feature complement(225..264): est; blastn; identity 92; region 478..517
  id N30852
  misc_feature complement(320..349): est; blastn; identity 96; region 394..423
  id N30852
  misc_feature complement(238..271): est; blastn; identity 94; region 481..514
  id AA044232
  misc_feature 303..349: est; blastn; identity 100; region 5..51
  id R78468
  est
  misc_feature 55,350,352..353,355: n=a, g, c or t
  unsure -21: position -21 of amino acid sequence
  unsure -9: Xaa = Asn,Thr
  position -9 of amino acid sequence
  unsure -6: Xaa = Ala,Ser
  position -6 of amino acid sequence
  unsure -5: Xaa = Phe,Leu
  position -5 of amino acid sequence
  unsure -4: Xaa =  * ,Glu,Gly,Trp; position -4 of amino acid sequence; Xaa = Phe,Ser
aaagtcctagagggggtcggggtmtgggtggacaagctttcctcgtcctctcccnacagagctgacgtgtcctgggttccaccgggagcgggcatttccaccggacgggagggttcggggtgtccggggctggggaatacgtargggktgcsgcgccggtgtgggaagttggggcgtgtggctgcagtcccgggagttcttggagggggtcggcccaccgagcttccggaccggctgatctgcccgtagcttgccggagggagggcggagctgactctccgtcccttctcccatcccctcsagtggtgggtacgggcacctcgctggcgctctcctccctcctgtccctngnnsntctttgctgggatgcagatgtacagccgtcagctggcctccamcgagtggctcaccatccagggcggcctgcttggwkcgggtctcttskrgtyctcgctcactgcgggg

SEQ ID NO: 1580 - DNA, 384 bp, Homo Sapiens
  kidney
  sig_peptide 19..180: Von Heijne matrix
  score 4.30
  misc_feature 63..344: seq LIVWLLVKSFSES/GI; blastn; identity 97; region 56..337
  id AA203498
  misc_feature 7..65: est; blastn; identity 100; region 1..59
  id AA203498
  misc_feature 344..385: est; blastn; identity 97; region 338..379
  id AA203498
  misc_feature 63..292: est; blastn; identity 99; region 44..273
  id W87295
  misc_feature 292..344: est; blastn; identity 92; region 274..326
  id W87295
  misc_feature 20..65: est; blastn; identity 100; region 2..47
  id W87295
  misc_feature 344..385: est; blastn; identity 97; region 327..368
  id W87295
  misc_feature 33..344: est; blastn; identity 98; region 1..312
  id AA248429
  misc_feature 344..385: est; blastn; identity 97; region 313..354
  id AA248429
  misc_feature 76..344: est; blastn; identity 98; region 1..269
  id W01758
  misc_feature 344..385: est; blastn; identity 97; region 270..311
  id W01758
  misc_feature 63..234: est; blastn; identity 97; region 30..201
  id AA249697
  misc_feature 33..65: est; blastn; identity 100; region 1..33
  id AA249697
  misc_feature 257..289: est; blastn; identity 100; region 222..254
  id AA249697
  misc_feature 227..256: est; blastn; identity 96; region 193..222
  id AA249697
  unsure 64: est
  position 64 of amino acid sequence
  unsure 51: Xaa = Ile,Met
  position 51 of amino acid sequence
  unsure 50: Xaa = Glu,Gly,Gln,Arg; position 50 of amino acid sequence; Xaa = His,Leu,Arg
atctggctcagttccgccatggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagacagaattcttctaagaccacgagagaaaaagttgggactaggaactgcatatattcdysraatgaaacatgcacaggaaactacatcattattatggatsctgatctctcac

SEQ ID NO: 1581 - DNA, 332 bp, Homo Sapiens
  Heart
  sig_peptide 207..266: Von Heijne matrix
  score 4.30
  misc_feature 36..268: seq LLDSSLMASGTAS/RS; blastn; identity 97; region 13..245
  id AA134651
  misc_feature 266..303: est; blastn; identity 97; region 244..281
  id AA134651
  misc_feature 14..272: est; blastn; identity 97; region 95..353
  id W26888
  misc_feature 61..262: est; blastn; identity 99; region 7..208
  id T66207
  misc_feature 263..325: est; blastn; identity 98; region 208..270
  id T66207
  misc_feature 39..267: est; blastn; identity 96; region 1..229
  id W00383
  misc_feature 35..304: est; blastn; identity 96; region 13..282; id HSC36A071; est
aaaccgggkgtagacgtacctcacggaagccggctttggccctgcggctkytaccgtcgccgcggagaaattgttggatctggcagtctaggaatgaatctcctctcagcctttaagctcacctggtcagaatccttggatgagcctgtgggaccgttcctcctagcccggtggtttggaaccagtggctttgggactgtaagaggatggacaaagattctcaggggctgctagattcatccctgatggcatcaggcactgccagccgctcagaggatgaggagtcactggcagggcagaagcgagcctcctcccaggccctgggcaccggg

SEQ ID NO: 1582 - DNA, 348 bp, Homo Sapiens
  kidney
  sig_peptide 100..207: Von Heijne matrix
  score 4.20
  misc_feature 126..226: seq CLAVSWEAAGCHG/AG; blastn; identity 95; region 38..138
  id AA009514
  misc_feature 252..343: est; blastn; identity 98; region 161..252
  id AA009514
  misc_feature 102..131: est; blastn; identity 93; region 15..44
  id AA009514
  unsure -26: est
  position -26 of amino acid sequence
  unsure -25: Xaa = Asn,Thr
  position -25 of amino acid sequence
  unsure -24: Xaa = Met,Arg; position -24 of amino acid sequence; Xaa = Leu,Arg
aaaggaatactgacagataaggccggaaacaaaactgatggcttgaaaaacatttttatggaatgtatttactatcattttgttttactatagaggtagatgggactcttaacttttgggtacattgaaamcakgckgaaaactgaacacaatcctgatcatcactcctgcctggctgtctcctgggaggctgccgggtgccacggagctgggacacagcagagcccgctaggtgttgcagggccctggaggccaaggccaccctgtgtggggtccctgttggcagccaggtccctacacaaacaagtaatcctgtttggcctcctaggttttgcatatgaccactgg

SEQ ID NO: 1583 - DNA, 206 bp, Homo Sapiens
  Dystrophic muscle
  sig_peptide 12..59: Von Heijne matrix
  score 4.10
  misc_feature 73..208: seq YAAVAGVLAGVES/RQ; blastn; identity 97; region 53..188
  id T06781
  misc_feature 20..80: est; blastn; identity 91; region 1..61
  id T06781
  misc_feature 16..105: est; blastn; identity 95; region 1..90
  id AA101354
  unsure 19: est
  position 19 of amino acid sequence
  unsure 27: Xaa = Ala,Thr
  position 27 of amino acid sequence
  unsure 36: Xaa = Lys,Asn; position 36 of amino acid sequence; Xaa = Cys,Tyr
agcgcgggaacatggggctgtacgctgcggtggcaggcgtgctggccggcgtggagagccgccagggctctaatcaaggggctggtgtactccagcaacttccagaacgtgaarcagctgtacgcgctggtgtgcgaaasgcagcgctactccgccgtgctggatrccgtgatctccarcgccggcctcctcagtgcgaagaagct

SEQ ID NO: 1584 - DNA, 299 bp, Homo Sapiens
  Heart
  sig_peptide 18..203: Von Heijne matrix
  score 4.10
  misc_feature 26..219: seq LDAVIASAGLLRA/EK; blastn; identity 91; region 1..194
  id T06781
  misc_feature 204..234: est; blastn; identity 93; region 176..206
  id T06781
  misc_feature 22..74: est; blastn; identity 90; region 1..53
  id AA101354
  misc_feature 71..110: est; blastn; identity 92; region 51..90; id AA101354; est
aaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcctccgtgcggagaagaagctgcggccgcacctggccaaggtgctagtgtatgagttgttgttgggaaagggctttcgagggggtgggggccgatggaaggcccgg

SEQ ID NO: 1585 - DNA, 457 bp, Homo Sapiens
  kidney
  sig_peptide 5..196: Von Heijne matrix
  score 4.10
  misc_feature 296..458: seq WLLRLAYLADIFT/KL; blastn; identity 100; region 1..163
  id R50658
  misc_feature complement(413..458): est; blastn; identity 100; region 442..487; id AA016001; est
agaaatgggtgctcagcacacagcacttcttctaaatacagaggtgaggtggctttctcgaggtaaagttcttgtaagactttttgaacttcgtcgtgaacttttggttttcatggattctgcttttcgactatctgattgtttaacaaattcatcttggctgctaagacttgcatatcttgcagatatttttactaaattaaatgaagttaatttgtcaatgcaaggaaaaaatgtgaccgtttttacagtatttgataaaatgtcgtcattgttaagaaaattggaattttgggcctcatctgtagaagaagaaaactttgattgttttcctacactcagtgattttttgactgaaattaattctacagttgataaagatatttgcagtgccattgtgcagcacctaaggggtttgcgcgctactctgttaaaatactttcctgtaacaaatgac

SEQ ID NO: 1586 - DNA, 248 bp, Homo Sapiens
  Heart
  sig_peptide 117..191: Von Heijne matrix
  score 4.00
  misc_feature 60..247: seq LVVMVPLVGLIHL/GW; blastn; identity 95; region 19..206
  id AA044042
  misc_feature 70..247: est; blastn; identity 97; region 6..183
  id AA127902
  misc_feature 88..247: est; blastn; identity 99; region 1..160
  id AA056679
  misc_feature complement(99..247): est; blastn; identity 99; region 302..450
  id W93399
  misc_feature 90..237: est; blastn; identity 97; region 11..158; id R29154; est
aatccgcggcagagcggctgcttgagatctgtttctggggcctctggcggtggcggcctgtggcggcctggggcggcgcgacggctggtgcgcaggtacactgatgctgaagtactatgagccttcggaacttgtggagagactacaaagttttggttgttatggtccctttagttgggctcatacatttggggtggtacagaatcaaaagcagccctgttttccaaatacctaaaaacgacaacatg

SEQ ID NO: 1587 - DNA, 389 bp, Homo Sapiens
  Heart
  sig_peptide 75..227: Von Heijne matrix
  score 3.90
  misc_feature 245..374: seq GKLLQLVLGCAIS/CE; blastn; identity 97; region 20..149; id T41381; est
aaaaataaaatgtaggcagcaaaagtggaagaggagaggcagctggtgcactaatccaggtcagcaatctgaagatggtcttacggagcctagtagagtactcccaggatgtcctggcgcatcctgtgtcagaagagcatctcccagatgtgagcctcattggagagttctcagacccggcagagctcggcaagctgcttcagctggtgctgggctgtgccatcagttgcgagaaaaagcaggaccacatccagagaatcatgacgctggaagaatcggttcagcatgtggtgatggaagccatccaagagctcatgaccaaagacactcctgactccctgtcaccagagacgtatggcaactttgacagccagtcccgcagtactggg

SEQ ID NO: 1588 - DNA, 405 bp, Homo Sapiens
  kidney
  sig_peptide 358..396: Von Heijne matrix
  score 3.90
  misc_feature 241..406: seq MIHGFCLAPTTSA/KN; blastn; identity 99; region 105..270
  id AA084830
  misc_feature 200..229: est; blastn; identity 100; region 64..93
  id AA084830
  misc_feature 241..406: est; blastn; identity 99; region 66..231
  id W01570
  misc_feature 200..229: est; blastn; identity 96; region 26..55
  id W01570
  misc_feature 296..406: est; blastn; identity 99; region 1..111
  id H82170
  misc_feature 298..406: est; blastn; identity 100; region 7..115
  id N71014
  misc_feature complement(147..201): est; blastn; identity 96; region 238..292; id N35296; est
atgggggcggastagccggagccgcgagtccattttggggctgtgcttggcgcgtaccgtgcggtccctgtagttggaggacgggcggtcgcgcsggcctttcccactagccggaggtcggagataagtacccgccgcccggcttctctcgggaaagcggggtggtcctcgaaccttcagcgagggtggggagttgcccagtagcctctagttcgttagtcaaaacgtgaaaaaaaaagacctgctttgccvtgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgct

SEQ ID NO: 1589 - DNA, 167 bp, Homo Sapiens
  kidney
  sig_peptide 90..140: Von Heijne matrix
  score 3.70
  misc_feature 24..86: seq RTWCLACVEASPG/QP; blastn; identity 95; region 1..63
  id C16698
  misc_feature 25..86: est; blastn; identity 95; region 9..70
  id H48377
  misc_feature 38..86: est; blastn; identity 95; region 36..84
  id R17245
  misc_feature 38..86: est; blastn; identity 95; region 7..55
  id H19182
  misc_feature complement(19..54): est; blastn; identity 91; region 181..216
  id T12463
  unsure -16: est; position -16 of amino acid sequence; Xaa = Leu,Pro
aagcctgggacaccgccggcggggagagaagcggatcccgtccgagccccggccccaagtaacgccgccgccccggagccgccgtgagtatgcyttgtcccaggacctggtgtctcgcctgcgttgaagcatctccagggcagcccttcctcccgccccgccccggg

SEQ ID NO: 1590 - DNA, 224 bp, Homo Sapiens
  Dystrophic muscle
  sig_peptide 24..86: Von Heijne matrix
  score 3.70
  misc_feature 89..222: seq ETCALASHSGSSG/SK; blastn; identity 97; region 93..226
  id W81645
  misc_feature 26..90: est; blastn; identity 95; region 31..95
  id W81645
  misc_feature 89..222: est; blastn; identity 97; region 62..195
  id W06951
  misc_feature 33..90: est; blastn; identity 96; region 7..64
  id W06951
  misc_feature 45..222: est; blastn; identity 97; region 2..179
  id W38711
  est
  misc_feature 3: n=a, g, c or t
  unsure 41: position 41 of amino acid sequence; Xaa = Ile,Leu
gcngtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatggatgcctgtmttagatgtcaagcgggg

SEQ ID NO: 1591 - DNA, 356 bp, Homo Sapiens
  kidney
  sig_peptide 273..350: Von Heijne matrix
  score 3.70
  misc_feature 122..188: seq IIMFLLIIVCGSP/RP; blastn; identity 100; region 198..264
  id R58050
  misc_feature complement(122..188): est; blastn; identity 100; region 193..259
  id H98670
  misc_feature complement(122..188): est; blastn; identity 100; region 194..260
  id N66980
  misc_feature complement(122..188): est; blastn; identity 100; region 198..264
  id AA159781
  misc_feature complement(122..188): est; blastn; identity 100; region 161..227
  id H45410
  unsure -15: est
  position -15 of amino acid sequence
  unsure -14: Xaa =  * ,Tyr; position -14 of amino acid sequence; Xaa =  * ,Glu
tagaagtagcaggatcgccttaataataataatagttttgtagcatgaagcctgagcattgtccaaagtttggaaatgtgaacgctgatagtcacatctgtccatctttccacatttctaggatgctgacagacagcaccaagaagtaattgcaatttatcggacacaccttcttagtgctgcacaggtaaagaactacttctcctttggaaagaatattgctttagagataataatttttattttcaaataaatttatgtgaaagtaattgatgtttaaagtagctgcaccccctatgcttatttawkaaataattatgtttcttttaatcattgtttgtggatctcccaggccg

SEQ ID NO: 1592 - DNA, 216 bp, Homo Sapiens
  Muscle
  sig_peptide 64..126: Von Heijne matrix
  score 3.60
  misc_feature complement(87..181): seq FXMCLWSLRNLFS/RC; blastn; identity 98; region 228..322
  id N29854
  misc_feature complement(1..46): est; blastn; identity 100; region 363..408
  id N29854
  misc_feature complement(44..93): est; blastn; identity 94; region 315..364
  id N29854
  misc_feature complement(87..181): est; blastn; identity 98; region 67..161
  id T32629
  misc_feature complement(1..93): est; blastn; identity 97; region 154..246
  id T32629
  misc_feature complement(87..181): est; blastn; identity 98; region 230..324
  id W61289
  misc_feature complement(6..93): est; blastn; identity 97; region 317..404
  id W61289
  misc_feature complement(87..181): est; blastn; identity 97; region 232..326
  id N53422
  misc_feature complement(3..93): est; blastn; identity 97; region 319..409
  id N53422
  misc_feature 87..181: est; blastn; identity 98; region 78..172
  id N50275
  misc_feature 9..93: est; blastn; identity 94; region 1..85
  id N50275
  unsure -12: est; position -12 of amino acid sequence; Xaa = Glu,Lys
agctatttggatagtgtagctttaatgtgctgcacatgatactggcagccctagagttcatagatggacttttgggacccagcagtttttraaatgtgtttatggagtttaagaaatttattttccaggtgcagcccctgtctaactgaaatttctcttcaccttgtacacttgacagctgaaaaaaaacaacatgggagtaataatgggtcggcg

SEQ ID NO: 1593 - DNA, 273 bp, Homo Sapiens
  kidney
  sig_peptide 160..261: Von Heijne matrix
  score 3.60
  misc_feature 9..122: seq SVPLLSLSHSIGI/SP; blastn; identity 97; region 1..114
  id R56502
  misc_feature 173..269: est; blastn; identity 100; region 162..258
  id R56502
  misc_feature 129..172: est; blastn; identity 95; region 119..162; id R56502; est
agtgaccaaatgacttaaccacagatggagtgaagacaggggtaactgcttggtctggtccccagtagagcattgctcactataaaccacaagctgcttctaatttatttgagrtgktawtaaycgtggsccttkatattctggtctctcttgctgcaaatgagtccggcaggcaagcacaactcagaaagcaaattcaccttctttgtagcccttgatgggtcggtccccctgttgtctctttctcattccataggcatttcccccacaagg

SEQ ID NO: 1594 - DNA, 163 bp, Homo Sapiens
  Heart
  sig_peptide 23..73: Von Heijne matrix
  score 3.50
  misc_feature complement(78..160): seq LVCVGLHTEGPWG/RP; blastn; identity 97; region 149..231
  id H15081
  misc_feature complement(1..71): est; blastn; identity 98; region 238..308
  id H15081
  misc_feature complement(2..71): est; blastn; identity 98; region 234..303
  id H16744
  misc_feature complement(78..160): est; blastn; identity 96; region 148..230
  id R61691
  misc_feature complement(2..72): est; blastn; identity 98; region 236..306
  id R61691
  misc_feature complement(2..85): est; blastn; identity 90; region 223..306
  id H17833
  misc_feature complement(109..160): est; blastn; identity 96; region 148..199; id H17833; est
atgtggtgbttgtgtcttaactatgcactgggcccttgtctgcgtcggcttgcatacagagggcccctggggtcggccctccggcctggcctcagccagtgggatggacagggccaggcaggcctctgaacttccacctcctggggcctcccagaccccccag

SEQ ID NO: 1595 - DNA, 256 bp, Homo Sapiens
  kidney
  sig_peptide 20..235: Von Heijne matrix
  score 3.50
  misc_feature 86..256: seq WFYIGSSLNGTRG/KR; blastn; identity 98; region 155..325
  id H16532
  misc_feature 5..62: est; blastn; identity 98; region 1..58
  id H16532
  misc_feature 86..256: est; blastn; identity 98; region 170..340
  id H17763
  misc_feature 8..62: est; blastn; identity 100; region 1..55
  id H17763
  misc_feature 86..165: est; blastn; identity 96; region 168..247
  id R21494
  misc_feature 11..62: est; blastn; identity 100; region 1..52
  id R21494
  misc_feature 183..222: est; blastn; identity 97; region 268..307
  id R21494
  misc_feature 86..238: est; blastn; identity 98; region 111..263
  id AA084554
  misc_feature 86..256: est; blastn; identity 97; region 136..306
  id R52491
  unsure -38: est
  position -38 of amino acid sequence
  unsure -33: Xaa = Cys,Asp,Gly,Asn,Ser,Tyr; position -33 of amino acid sequence; Xaa = Ala,Gly
agagctcgctgtggcccggatgttcggtgcagctgccagatccgctgatctagtgcttctcgaaaaaaaccttcaggcggcccatgggtatgcccaagaggacagagaacgaatgcacagadrtattgtcagccttgsacagaatctcctgaactttatgattggctctatcttggatttatggcaatgcttcctctggttttacattggttcttcattgaatggtactcggggaaaaagagttccagcgcacttt

SEQ ID NO: 1596 - DNA, 132 bp, Homo Sapiens
  Heart
  sig_peptide 43..123: Von Heijne matrix
  score 3.50
  misc_feature 3..116: seq VVALLIVCDVPSA/SA; blastn; identity 100; region 1..114
  id N87112
  misc_feature 50..130: est; blastn; identity 98; region 1..81
  id AA094982
  misc_feature 52..130: est; blastn; identity 100; region 1..79
  id T68050
  misc_feature 47..130: est; blastn; identity 96; region 1..84
  id AA157180
  misc_feature 50..130: est; blastn; identity 97; region 1..81; id AA186993; est
agccggagcaaagtttcacttatagaagggagaggagcgaacatggcagcgcgttggcggttttggtgtgtctctgtgaccatggtggtggcgctgctcatcgtttgcgacgttccctcagcctctgcccgg

SEQ ID NO: 1597 - DNA, 436 bp, Homo Sapiens
  kidney
  sig_peptide 245..292: Von Heijne matrix
  score 3.50
  misc_feature 73..238: seq LLLQPSMIQEVWT/XY; blastn; identity 100; region 16..181
  id W32979
  misc_feature 316..394: est; blastn; identity 96; region 260..338
  id W32979
  misc_feature 251..322: est; blastn; identity 98; region 194..265
  id W32979
  misc_feature 251..437: est; blastn; identity 99; region 107..293
  id AA128556
  misc_feature 145..238: est; blastn; identity 100; region 1..94
  id AA128556
  misc_feature 251..381: est; blastn; identity 98; region 104..234
  id T20234
  misc_feature 153..238: est; blastn; identity 98; region 6..91
  id T20234
  misc_feature 383..437: est; blastn; identity 98; region 235..289
  id T20234
  misc_feature 115..238: est; blastn; identity 100; region 65..188
  id T32594
  misc_feature 251..318: est; blastn; identity 95; region 201..268
  id T32594
  misc_feature 52..115: est; blastn; identity 98; region 1..64
  id T32594
  unsure 1: est; position 1 of amino acid sequence; Xaa =  * ,Leu,Ser
atcagacgccagtataagcctttgagtctcaatagactgcagtatcttattgatttgggtcgtgttgatcctagtcaacctattgacttaacccagcttgtcaatgggagaggtgtgaccatccagccacttaaaagggattatggtgtccagctggttgaggagggtgctgacacctttacggcaaaagttaatattgaagtacagttggcttcagaactagctattgctgccattgaaaaaaatggtggtgttgttactacagccttctatgatccaagaagtctggacathgtatgcaaacctgttccattctttcttcgtggacaacccattccaaaaagaatgcttccaccagaagaactggtaccatattacactgatgcaaagaaccgtgggtacctggcggatcctgccaaatttcctgaagcacgac

SEQ ID NO: 1598 - DNA, 406 bp, Homo Sapiens
  kidney
  sig_peptide 149..241: Von Heijne matrix
  score 10.50
  misc_feature 82..407: seq LAVLLSLAPSASS/DI; blastn; identity 98.5; region 1..326
  id HSARSE
  misc_feature 88..171: vrt; blastn; identity 96; region 1..84
  id AA160312
  est
  misc_feature 343: n=a, g, c or t
  unsure -26: position -26 of amino acid sequence
  unsure 34: Xaa = His,Pro; position 34 of amino acid sequence; Xaa = Lys,Asn,Arg,Ser
aaaactcgaagttaatcattcccagctcaaagccttgtgcaagtgctctctgccttcacgcttgcttcctttgggagagaaccttcctcttcttgatcggggattcaggaaggagcccaggrgcagaggaagtagagagagagrcaacatgttacatctgcaccmttcttgtttgtgtttcaggagctggctgccagcgatgctcgctgtactgctaagtttggcaccatcagcttccagcgacatttccgcctcccgaccgaacatccttcttctgatggcggacgaccttggcattggggacattggctgctatggcaacaacaccatgaggactccgarnattgaccgccttgcagaggacggcgtgaagctgacccaacacatctctgccgcatctttgtgc

SEQ ID NO: 1599 - DNA, 195 bp, Homo Sapiens
  Substantia nigra
  sig_peptide 109..171: Von Heijne matrix; score 14.30; seq LLLCAVLLSLASA/SS
agagactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcaatggg

SEQ ID NO: 1600 - DNA, 162 bp, Homo Sapiens
  brain
  sig_peptide 55..138: Von Heijne matrix; score 11.10; seq GLLFLLLLLMLLA/DP
aagagcccagagagctgaacctgcatcccggacctgcggcgaccgtcgtacaccatgggcctccacctccgcccctaccgtgtggggctgctcccggatggcctcctgttcctcttgctgctgctaatgctgctcgcggacccagcgctcccggccgctagg

SEQ ID NO: 1601 - DNA, 421 bp, Homo Sapiens
  brain
  sig_peptide 20..82: Von Heijne matrix
  score 10.60
  seq LLLGAVSWPPASA/SG
  misc_feature 288..289: n=a, g, c or t
  unsure 74: position 74 of amino acid sequence
  unsure 70: Xaa = Ala,Gly,Pro,Arg
  position 70 of amino acid sequence
  unsure 69: Xaa = Asp,Asn
  position 69 of amino acid sequence
  unsure 61: Xaa =  * ,Cys,Phe,Leu,Ser,Trp,Tyr; position 61 of amino acid sequence; Xaa = Ile,Val
agcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacggaggagtgggtgcttrtcctgcctccatggggccgcctctnnractggcagagtsstgacatccaccaggtccggattccctggtctgagttttttgatcttccaagtctcaataaaaacatccccgtcatcgagtatgagcagttcatcgcagaatctggtgggccctttatt

SEQ ID NO: 1602 - DNA, 182 bp, Homo Sapiens
  brain
  sig_peptide 6..167: Von Heijne matrix; score 9.10; seq VLCLRGLVSLAFQ/GP
aacaaatgtttttatttttgtcaccagccacccctgtcctgccgccttctctcgactccagagacctgttgcctcatctcttttggggaagagccggcagctcctcctcatcccctgccttaagtccagttctttgcctcaggggtctcgtttccttggccttccagggtccccaccccgag

SEQ ID NO: 1603 - DNA, 272 bp, Homo Sapiens
  Substantia nigra
  sig_peptide 63..125: Von Heijne matrix; score 8.80; seq LLWALLFMQSLWP/QL
agcagtgcagcattaatgggccgctgacatgaatatggagtagttttctctagcaaagagtaatgtgggccatggagtcaggccacctcctctgggctctgctgttcatgcagtccttgtggcctcaactgactgatggagccactcgagtctactacctgggcatccgggatgtgcagtggaactatgctcccaagggaagaaatgtcatcacgaaccagcctctggacagtgacatagtggcttccagcttcttaaagtctgacgatggg

SEQ ID NO: 1604 - DNA, 195 bp, Homo Sapiens
  brain
  sig_peptide 130..186: Von Heijne matrix; score 8.70; seq ILGLLCCVLATMA/NP
aaactaaaatttcatgcaaagttgatgccatttcaacatgaatatgattctatatagtaagttgaatgtgtagaaattcagatatctggaagttatgaaacaaggaatcaattaggtatacaaaagccgatgactcactatagaaatattcttggtctcctgtgctgtgtattagcaaccatggccaaccccggg

SEQ ID NO: 1605 - DNA, 333 bp, Homo Sapiens
  Substantia nigra
  sig_peptide 253..297: Von Heijne matrix
  score 8.40
  seq LLLLLASLIERSS/KT
  misc_feature 3,138,312..313: n=a, g, c or t
  unsure 5: position 5 of amino acid sequence
  unsure 6: Xaa =  * ,Phe,Leu,Tyr; position 6 of amino acid sequence; Xaa =  * ,Gly,Arg
aantcattcttttgcctggagttttgtgaggtacccgcttgctttatgggaaaaggctgctccggaactgccctactttagactttttcatggttatcaatckgkacamagaatcaccaaactgataaagcaggaacnagagggcaaatcacgctgccaagacaactgtgtaattcgctcgaaaaagaaacgaagacaatgtatataaaaatatgcaagaatcacaggaaacccacatatccaaccacctagatgaagttgttgctgctgttagcatcactcatagaaagaagttccaaaacaagctgctwnngacagcactattccagccag

SEQ ID NO: 1606 - DNA, 219 bp, Homo Sapiens
  Substantia nigra
  sig_peptide 64..177: Von Heijne matrix
  score 8.20
  unsure -11: seq SFXLFLALCASFS/FF
  position -11 of amino acid sequence
  unsure 4: Xaa = Leu,Trp; position 4 of amino acid sequence; Xaa = Cys,Phe
atatttaatttattatcttccttaatttgtagatgagaaactgaggcatagtaatggacaggaatggctaggaatcaagccttggtctgccttccctcttttcagaatgcctttattcctgttgaagatcttcccacatcattttkgctctttctcgccctctgtgcttccttctccttttttttatktctttctctttccctcccttccttctttttt

SEQ ID NO: 1607 - DNA, 286 bp, Homo Sapiens
  Substantia nigra
  sig_peptide 164..268: Von Heijne matrix; score 8.20; seq SLLLLFYSFYVLA/VK
acattatttgtcaaaacctcattaaggttttgacaacaaatgataattggaaacagttttctggctcctttagtagtagcatgtcattttatctgcttcttggccttagtatgtttgaagtgaaactgttwrabvwagatgtttgtatttggttcaagcttaaatgccaaatgaatcttggcaaattccatgtggcaagcaagaagctgaaactctattcaacttccaaagcttgttgttgttattttattccttctatgttctagctgttaaaagagggccaggg

SEQ ID NO: 1608 - DNA, 209 bp, Homo Sapiens
  Substantia nigra
  sig_peptide 93..200: Von Heijne matrix; score 8.00; seq LVLLICLVSSYLP/QL
aattacttcaactgttgactatattttgtttatrtttctcatactgttgtttcttgaatccattccagtcaggtgtgtgcccccatcacttcatgcaaactacttttatcgatgtcactgttgaccaacatgttgctaaatctaatgatcacttgtcagtcctagtcttacttatttgcttagtctcatcttatttgccacagctcccg

SEQ ID NO: 1609 - DNA, 363 bp, Homo Sapiens
  brain
  sig_peptide 124..342: Von Heijne matrix
  score 7.80
  seq YLPLLAGLGLTLA/AP
  misc_feature 301: n=a, g, c or t
  unsure -60: position -60 of amino acid sequence
  unsure -14: Xaa = Glu,Gly; position -14 of amino acid sequence; Xaa =  * ,Gly,Arg
aagggtccgccagctcggggccagcgcatggggctgctgagaccgctccggacgtgcgaasgttcgcggtgcggtaggaagctgaagtcttcagcagaaccctgacctaggtagggagtctcaatggccctgggtgaagaaaaggcagaagcggaagcatctgrrgacacaaaggcccagtcctatgggagagggagctgcagggagcgggagctggacatcccagggcccatgagtggggagcagcccccacgcctggaagctgagggagggctcatctcccctgtatggggggcagaangatacctgcccctacttgctggattgggactgaccctggcggcccctctagagcccacaacg

SEQ ID NO: 1610 - DNA, 271 bp, Homo Sapiens
  Substantia nigra
  sig_peptide 149..211: Von Heijne matrix; score 7.70; seq LLCISPFVPFTSG/NK
aaaactctatgagtgtctttttgagaccataaagcagactttagtaactttctatttctgtaagtactaaatgtctggcattttaaacttttgtagaatacataatgttgracactggaataatactattkattttcacctgtgaaaaatgacttcattgtacttgaaacacctcctttgcatttctccatttgtgccattcactagtggaaataaattgtattataccatgatctactggctttttaaaactgtattaaatatgcacggg

SEQ ID NO: 1611 - DNA, 378 bp, Homo Sapiens
  Cerebellum
  sig_peptide 205..345: Von Heijne matrix; score 7.60; seq CLATLTLFHTSFS/FQ
agggctctccatgaagcgggtgttgtcaacttacttggaaccagatattgagcacttattttatatcaggcagaatacagagccacttayatgrkwtcaatkaattcttacaactcccttgggaargaggtgtttgtcttctttccatttaacagatgagaagactgagacttgatgagtttagtcaattgttctgagtagtaaatgacagactctcccaatgctcatggcttagctctcaccaccaagtggatgatgcctgctgtctctttgaacttgacctattacttgccatcttggtacctttgtttggccactcttactttattccacacctctttctccttccaagcttctgagtctgtcaaagccatcacg

SEQ ID NO: 1612 - DNA, 376 bp, Homo Sapiens
  Substantia nigra
  sig_peptide 143..286: Von Heijne matrix
  score 7.50
  unsure 12: seq FVILLLFIFTVVS/LV
  position 12 of amino acid sequence
  unsure 13: Xaa = Asp,Glu; position 13 of amino acid sequence; Xaa = Cys,Ser
aatcgcttcagcagcatcctctcagacaagagccactatttctgattcagatcacctgtcatcgaagtttaaagaaggggaaacaggagacagaaatacactgaaccaaaaagattcaaaagagcaagtggaatctctaagaatggcttccagccactggaatgaaaccactacctctgtttatcagtaccttggttttcaagttcaaaaaatttaccctttccatgacaactggaacactgcctgctttgtcatcctgcttttatttatatttacagtggtatctttagtggtgctggctttcctttatgaagtgcttgamwgctgctgctgtgtaaaaaacaaaaccgtgaaagacttgaaaagtgaacccaag

SEQ ID NO: 1613 - DNA, 429 bp, Homo Sapiens
  brain
  sig_peptide 298..372: Von Heijne matrix
  score 7.40
  seq IFLLNMWVACLLS/GE
  misc_feature 399: n=a, g, c or t
  unsure 9: position 9 of amino acid sequence
  unsure 10: Xaa = Lys,Asn; position 10 of amino acid sequence; Xaa = Ile,Leu
actgagatccacctgggctcccaagacagatagtggggtcttgtccagttcatatattatctacagttgccaatgtgatataaaatatgatttaggtcatatcacctacttgaaagtctgcactggtgctgtcttggtaacagaaagagaaagactgaattcccttattttgcccatcaggctctccttgatatagtctctgcccacccacctctccaacctcacatcatctctcttctgcctcatacgctatgctccggcacgtataggttcctatacaattttgtttcatacttgatgtctttactttttgtcttttgcctggaatgcagtatttttctattgaatatgtgggttgcttgccttctgagtggtgagattccccattcctcatggaanmtaaagttaattggcaccttgcccacttct

SEQ ID NO: 1614 - DNA, 244 bp, Homo Sapiens
  Substantia nigra
  sig_peptide 149..202: Von Heijne matrix
  score 7.40
  unsure 11: seq VLLLLPLVAFITL/KF; position 11 of amino acid sequence; Xaa = His,Leu,Gln
aaaatttcaaaacgtaggataaaaggaatcaaatgtattaatggawaakcaactgaacttaatttcgattcttttctatcattttttcctaggctakagatagactaaattcatatctgaaaattctcaatttttgagaaaagacaaaatgtttgtcgttacagttttgttgttgctgcccttagttgctttcattaccctcaaattctgtaacttgattaattttccaactcwkagacacggg

SEQ ID NO: 1615 - DNA, 212 bp, Homo Sapiens
  Substantia nigra
  sig_peptide 12..77: Von Heijne matrix; score 7.20; seq IIYALQFLFLVFA/PS
aattcaatcaaatgaaccgatcttgtagaaacactggaatcatttatgcgttgcagtttctctttcttgttttcgctccttcttccctgggatattttgagtggattgtggctattaatcaagatctcgtgctattcgtgttttgcttgtcgttttcgctcaggattagcatcattcaaggcaaacgcaaagctgcttttcccacccccccc

SEQ ID NO: 1616 - DNA, 221 bp, Homo Sapiens
  Cerebellum
  sig_peptide 87..191: Von Heijne matrix; score 7.20; seq LSLLLAWVTLTHL/LS
accttcgacccccaccctgggaataccaatccagtgattccaccatctactcactgtccctcatcgttggtgtcttctctaacttcatgacccaaaccacatggggagcccccaccagggccagcaatcaccctctccctgcatggctcaccctcagcctcctcctggcctgggtgacccttacacaccttctctctgtgctcacacatccaaccctcctg

SEQ ID NO: 1617 - DNA, 328 bp, Homo Sapiens
  Substantia nigra
  sig_peptide 74..121: Von Heijne matrix
  score 7.10
  seq XXAVLCVCAAAWC/SQ
  misc_feature 7,86..87: n=a, g, c or t
  unsure -13: position -13 of amino acid sequence
  unsure -12: Xaa = Asp,Glu,Gly,Val
  position -12 of amino acid sequence
  unsure 13: Xaa =  * ,Ala,Glu,Gly,Ile,Lys,Leu,Pro,Gln,Arg,Ser,Thr,Val
  position 13 of amino acid sequence
  unsure 66: Xaa = Ala,Ser,Thr; position 66 of amino acid sequence; Xaa = Pro,Arg
agaaasnccgagttggcagagcagggctgcatttccagcaggagctgcgagcacagtgctggctcacaacaagatgctcaaggdvnnagccgtactgtgtgtgtgtgcagccgcttggtgcagtcagtctctcgcagctgccgcggcggtggctgcadccggggggcggtcggacggcggtaattttctggatgataaacaatggctcaccacaatctctcagtatgacaaggaagtcggacagtggaacaaattccgagacgatgattatttccgcacttggagtccaggaaaacccttcgatcaggctttagatcsagctaacggg

SEQ ID NO: 1618 - DNA, 233 bp, Homo Sapiens
  brain
  sig_peptide 168..227: Von Heijne matrix; score 6.90; seq LHLLGSSISPASA/SL
aatgaaaagcagtttgttattatgcaggaaaatcagtttcatcattttagttacactaaacacttttggcagcttaatatgacctttttaaattttttkttattttttttatttttatttctttaagatggagtcttgctctgttgcccgggctggagtacaatggcatgatctcagctcactgcaacctccacctcctgggttcaagcatttctcctgcctcagcctccctg

SEQ ID NO: 1619 - DNA, 170 bp, Homo Sapiens
  Substantia nigra
  sig_peptide 6..89: Von Heijne matrix
  score 6.90
  unsure -27: seq FLPFLLSLPLDQT/LP
  position -27 of amino acid sequence
  unsure -26: Xaa = Cys,Phe
  position -26 of amino acid sequence
  unsure -15: Xaa = Ala,Pro; position -15 of amino acid sequence; Xaa = Asp,Glu
aagatatgtkcscbaaagcctgcagaaccctcgcttggttgcctgasccgttcttaccctttctcctcagtcttcccttggaccagacgcttcctcgccagggtcctggccaatccctgtccttcccagaaaactaccagactcttcccaagagcacccgacaccctggg

SEQ ID NO: 1620 - DNA, 192 bp, Homo Sapiens
  Substantia nigra
  sig_peptide 19..75: Von Heijne matrix; score 6.80; seq GLLLVFLPHPQRG/GQ
acatcgcccgagcaggggatggcggtgaagcggctagggctgctgttggtgttcctgcctcatccgcagcggggaggacaggagaggtctgcccacaccccgaggcagcacccagctcgccccacttccctctcgcagggggagagaccaggacgcggtggggggtgggggaatggccgtgacgcccaccag

SEQ ID NO: 1621 - DNA, 433 bp, Homo Sapiens
  Substantia nigra
  sig_peptide 77..325: Von Heijne matrix
  score 6.80
  unsure 23: seq LLMILTFPFKILS/DA
  position 23 of amino acid sequence
  unsure 24: Xaa = Cys,Phe,Gly,Val; position 24 of amino acid sequence; Xaa = Ala,Gly,Arg,Thr
aaggctgcaataactactacttactggatacattcaaaccctccagaatcaacagttatcaggtaaccaacaagaaatgcaagccgtcgacaacctcacctctgcgcctgggaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatkkcrsaatgtatatcagtatttcattcctgggactgataact

SEQ ID NO: 1622 - DNA, 176 bp, Homo Sapiens
  Substantia nigra
  sig_peptide 12..119: Von Heijne matrix
  score 6.80
  unsure -5: seq LWFFLPSLXCPEC/CP; position -5 of amino acid sequence; Xaa = His,Pro
atctggtctgcatgtggaccctccccagcctcagtgcatcgtttcagccttttctgggcagccttcgcccttctcacatcctgtggttcttcctgccctccctccmctgcccagaatgctgccctcctgatccaggatctccagcctccagggaccctaacgtggcctgcgaacgg

SEQ ID NO: 1623 - DNA, 287 bp, Homo Sapiens
  brain
  sig_peptide 36..101: Von Heijne matrix; score 6.70; seq LLLFQPSSHSATG/SS
atgaaacaaaatatgttctaccagataaagtattgatgtccctaactgatgtccccatgtcccttctgctttttcaacccagttcccacagtgctactggatcatctatcaaaattataatacttaattacatcatactccagttcaaaacccttcaaacacttcctaatgctttgaggatacacatcaaagtctttcacatttactgttcatttgtttccaggtttcactattataaaaatactgccacagtatttttcaggtcagtattaaaaaggagaatgggg

SEQ ID NO: 1624 - DNA, 453 bp, Homo Sapiens
  Substantia nigra
  sig_peptide 238..288: Von Heijne matrix
  score 6.60
  seq LAFLLVSLYWSHM/HP
  misc_feature 87: n=a, g, c or t
aatagggctgaaccgaggactgaaaaagggaggaggcagaccactcggagaggagctgggaagcagtgcagagaggagagcggassnagctgccgctgagcaaagtgcgactgtatctggtttggcctgctcttcctcaccttcctcctttccctgagctggctgtacatcgggctcgtccttctcaatgacctgcacaacttcaatgaattcctcttccgccgctggggacactggatggactggtccctggcattcctgctggtatctctctactggtcacatatgcatccttgctattggtcctggccctgctcctgcggctttgtagacagcccctgcatctgcacagcctccacaaggtgctgctgctcctcattatgctgcttgtggcggctggccttgtgggactggacatccaatggcagcaggagtggcatagcttgcgtgtgt

SEQ ID NO: 1625 - DNA, 159 bp, Homo Sapiens
  brain
  sig_peptide 103..147: Von Heijne matrix; score 6.50; seq LLILFFMVGRIIP/SP
atattatattttttagtcagactcacagaattgagttgattttattcctcattgggtggcacactattatcgttcttcccaamcttgttcagtatttgtwttatgtatttactaatacttttctttatggtaggcagaattatcccttccccccaccgg

SEQ ID NO: 1626 - DNA, 245 bp, Homo Sapiens
  brain
  sig_peptide 78..221: Von Heijne matrix; score 6.50; seq LLVVSCCLLFHQA/IH
aatggattatgtgctatgtgcactccacagcctaagaactacaatcttggttgttgttaatttttgatacctaaaagatgaataagcctccctgggaagaatcctgggggcaaaatcaactctcaggtgagcccgctacttggagtctttgcatttctcctttgcctggaagagagccgagtttacttgttgtgtcttgttgcctcttgtttcatcaggctatccataataaattactgtggcgg

SEQ ID NO: 1627 - DNA, 299 bp, Homo Sapiens
  Substantia nigra
  sig_peptide 177..248: Von Heijne matrix; score 6.50; seq FLILLSIDSLVSG/FL
aattttttgcgacttattgaggttgtcttttctgtcattcaggaaagttttatggttttctctggaaaggtcttgcttgtttcttgttaggattcttgatacttttgagtctgtttcctcctttggtgtgtcataatggttattgatggtgtattgggaagttatagataatttggatgttgatcttagagctaacaatgatgctgagctttctaattctattgtcaattgattctcttgtatcgggttttttaagtaagcgaaaaggtctgcgcgtctgtgatggaagccggtccggg

SEQ ID NO: 1628 - DNA, 350 bp, Homo Sapiens
  Substantia nigra
  sig_peptide 183..338: Von Heijne matrix; score 6.40; seq CLLGAAWASRLRT/QP
aatagacgagtagaccttaggcgagggaaggcatgtactttccctaagaagcgggaggagagaaataaatagagggcagtgggatgagaagaacctcgcgggatgggaagccgcggagggaagggccgtctttggttacctggagagcgggagcagctgcggatcccttatgaagtgcccggatgaagctccagcgctcacgcgctttccgcattgagtgcagcgccatcttgagaagggcggagcgtcttgtktggaatgacgtctgttcagagagccaatcccagtctcgcgactcctgcttgctgggcgcggcttgggcctccaggctgcgcacgcagccgcatccg

SEQ ID NO: 1629 - DNA, 295 bp, Homo Sapiens
  Cerebellum
  sig_peptide 236..283: Von Heijne matrix; score 5.70; seq FTLCVFTLPFLCA/CL
acaaaagggaatgtattagtgtcccaggactactgtgacaaggcacaaaaaactgggtgctttacaacaagaaaactgtacagtgctggaggctagaagtcaaaatcaagtgattggttggaccatgctctctctgacagtgacaggggagaaccctccctcgcctctcctggcttctggtatgcaccagcaattcctggcgttccttggctcctagaagcatcactcctatcacatggtcatcttcaccctgtgtgtcttcacactaccctttctctgtgcatgtctgcccagg

SEQ ID NO: 1630 - DNA, 285 bp, Homo Sapiens
  Cerebellum
  sig_peptide 184..240: Von Heijne matrix; score 5.70; seq VLVVGTWSSQGQA/NS
aaaactctagaaatctgtgtttccggaaagcaggggtgggagccgcccagtgccttccccaaaacccaacactgagatttcaatgrtatgktttgkgagtctttttaaaaattctctctggttgctgggctcagtgaccacggtcaggtttggaagagcaccaggctgtgcgggccgaggcggatgtggggagcacttcctgtcctcgtggtgggaacctggtccagccaagggcaggcgaacagctgtgcggggcgggggatggggccagacgtgtgtggagcg

SEQ ID NO: 1631 - DNA, 247 bp, Homo Sapiens
  brain
  sig_peptide 143..190: Von Heijne matrix; score 5.70; seq LVCGFLQISLSLA/SL
agtgactgtacactgggtttctttggaaactgcgtcttttctcaataatggcaggatccccgattttagaaagtgggcagtgctttgtgttacagggtttgggctaaagactgtttgataaccaatattttacaagaattaaatgaccagattggtctgtggctttctccaaatttccttatccctagcttcattgtttctgacaattcctctaatgtggtacatgcaatcaaaatggtggcgtggg

SEQ ID NO: 1632 - DNA, 114 bp, Homo Sapiens
  brain
  sig_peptide 55..99: Von Heijne matrix; score 5.60; seq FLLPLLLHHLTFH/GR
aatctatttgtcctctagaaactcttcataatgccctatctttaaagcaagtggatgaatttcttgcttccattgcttctccatcatctgacgttccacggaagaccgctgaag

SEQ ID NO: 1633 - DNA, 367 bp, Homo Sapiens
  Substantia nigra
  sig_peptide 125..298: Von Heijne matrix
  score 5.50
  unsure -7: seq LIIFICXTASISA/YM; position -7 of amino acid sequence; Xaa = Phe,Ile,Val
ctgcttcactttcaggtttctcgaagtgccttcttgctcctgtctgtttccccatcctgccagatttctgtttctcttgctgggcttttggcagtagggggctgtgttggtgggccctacgaagatgctcagtgctcgagatcgccgggaccggcaccctgaggagggggtagttgcagagctccagggcttcgcggtggacaaggccttcctcacctcccacaagggcatcctgctggaaaccgagctggccctgaccctcatcatcttcatctgcdtcacggcctccatctctgcctacatggccgcggcgctactggagttcttcatcacacttgccttcctcttcctctatgccaccccagcg

SEQ ID NO: 1634 - DNA, 338 bp, Homo Sapiens
  brain
  sig_peptide 225..263: Von Heijne matrix
  score 5.50
  seq MLTMSVTLSPLRS/QD
  misc_feature 98: n=a, g, c or t
aagatgtgctgtaaacatcaaaagaagacggtgggatcaggagatgtttggacagctctttattcagaacatcaaggactgttgacagttgaataahnagggcggaggcttatgggattgctaatgagatacaaagccaccttggaataaaaataaahttctctctgttggctcctccggccatggagagctgttttvgaaagaagtgaggtttagacttctccatgttaaccatgagcgtgacactttcccccctgaggtcacaggacctggatcccatggctactgatgcttcacccatggccatcaacatgacacccactgtggagcagggactg

SEQ ID NO: 1635 - DNA, 279 bp, Homo Sapiens
  brain
  sig_peptide 100..237: Von Heijne matrix
  score 5.40
  seq FFLLISSVRPISQ/TF
  misc_feature 187: n=a, g, c or t
  unsure -44: position -44 of amino acid sequence
  unsure -17: Xaa = Ile,Met; position -17 of amino acid sequence; Xaa = Phe,Ile,Leu,Val
atttaaattttgtgatcaaagatgccaaatggacacaacaccataccctagttatttccctactgtgttttcctacaagcttacctgcatttagtamccatgtttatrcccgtagcactgatcttccccatctcagtaagtgaccctaccattcaccctattactcaagcccagaacctagaaagcntcctacagtccttctttcttctaatatcatctgtaagacccattagtcaaaccttcaaaatagatctttctccatctgtgcgggchaccggg

SEQ ID NO: 1636 - DNA, 192 bp, Homo Sapiens
  Substantia nigra
  sig_peptide 91..183: Von Heijne matrix; score 5.40; seq WCAVLRSWLAASS/AP
atgcaaaaaagcactgtgccttctgtcattgaatcctagaacactgagatgagaaaaacactgtagatgtataggttagatatatagggaatgttattattttttcctttttttggagagacggtctcgctccatcacccatgctggtgtgcagtgctgcgatcgtggctcgctgcatcctccgcccctcgg

SEQ ID NO: 1637 - DNA, 199 bp, Homo Sapiens
  Surrenals
  sig_peptide 32..136: Von Heijne matrix; score 5.40; seq LVVVCYLSWRVSS/RS
atactcaaaatctacatttcagttagttgatatgcctcttaagaatctgttctctgttggtctgtgggatccttacaatttactgaagaaacatgttttggttgttgtctgctatttatcctggagagtgtcttccagaagttggactttgctgattacacctgtaacacttcatgcttctctgtccacccaggcccgg

SEQ ID NO: 1638 - DNA, 418 bp, Homo Sapiens
  brain
  sig_peptide 209..265: Von Heijne matrix
  score 5.40
  unsure 10: seq LSHLLPSLRQVIQ/EP
  position 10 of amino acid sequence
  unsure 32: Xaa = Leu,Met,Pro,Thr; position 32 of amino acid sequence; Xaa =  * ,Tyr
atgtttgattggtgtgcctgaaagtgaaggggagaatgaaaacatctgccagctccgccgacccggcccccgcggccctcccagctcggctccggctcagtggacaggaaccactgaagtttgcctgacaccatcaaccaggccctagtcacctggctttgcctttgccctgctgtgtgatcttagctccctgcccaggcccacagccatggccatggcccagaaactcagccacctcctgccgagtctgcggcaggtcatccaggagcctcagctatctctgcagccagagmyggtcttcacggtggatcgagctgaggtgccgccgctcttctggaagccgtacatctatgcgggctamcggccgctgcatcagacctggcgcttctatttccgcacgctgttccagcagcacaac

SEQ ID NO: 1639 - DNA, 370 bp, Homo Sapiens
  brain
  sig_peptide 149..232: Von Heijne matrix
  score 5.40
  seq LALVALAPHSVQK/SX
  misc_feature 238: n=a, g, c or t
  unsure 2: position 2 of amino acid sequence
  unsure 3: Xaa = Phe,Leu,Ser
  position 3 of amino acid sequence
  unsure 17: Xaa = Ala,Pro,Thr
  position 17 of amino acid sequence
  unsure 29: Xaa = Ala,Glu,Val; position 29 of amino acid sequence; Xaa = Ala,Pro
atgcctcgacccctttagaagttccttttccccagtcatcctctggaacagccctacctttgggaactgcccctgaagccccaahccttcctamccaracctaatagggcctcccatctccccagctgccttagctctagcctctcccatgatagctccaactctgaaagggaccccttcctcttcagctcccttagctctggttgccctggctccccactcagttcagaagagttynvcttttccacctaaccttcttacttcacctccttcagtggctghagctgagtcagggtcagtgataactctgtcagctsccattgctccctcagaaccaaagactaatcttaataaagttccctctgaggta

SEQ ID NO: 1640 - DNA, 208 bp, Homo Sapiens
  brain
  sig_peptide 86..196: Von Heijne matrix
  score 5.30
  unsure -20: seq LVESLCLVFNLLS/LP
  position -20 of amino acid sequence
  unsure -19: Xaa = Arg,Thr; position -19 of amino acid sequence; Xaa = Leu,Val
agatatgtcaacacctaagaatcagaactagtatcttgaaaagttaggagccctggggttttgtttttgcttttgcttttaaaggatgtgtttgttccctgtatcaccgtgcccagcttactccttttcttcggaaasrsttggtgccgtattgttactggttgaatctctgtgtttggtttttaatttgttatctttgcccccaagg

SEQ ID NO: 1641 - DNA, 412 bp, Homo Sapiens
  brain
  sig_peptide 140..184: Von Heijne matrix
  score 5.30
  seq IAVLFCFLLLIIF/QT
  misc_feature 130: n=a, g, c or t
aaacattcccttctgtcctttctttgtttttaaagaaagctctgattttgtttcattttcagctggagacttaaatgacaccaagcaaagcctacttagtttagatctccagaaattggctggtggaavnraatcaaacatgaagattgcagttttgttttgttttttgctgcttatcatttttcaaactgactttggaaaaaatgaagaaattcctaggaagcaaaggaggaagatctaccacagaaggttgaggaaaagttcaacvtcacacaagcacagatcaaacagacagcttggaattccgcaaacaacagtttttacaccagtagcaagacttcctattgttaactttgattatagcatggaggaaaagtttgaatccttttcaagttttcctggagtagaatca

SEQ ID NO: 1642 - DNA, 169 bp, Homo Sapiens
  brain
  sig_peptide 80..160: Von Heijne matrix; score 5.20; seq VGAVLLSSLPISP/QY
accctaccatccataccctccattcttactccgtgtcatggagaaacctgcatagtgctggggattagtgccacaattaatgtgtagtccgaggtctcccttaaatctgtctttggtccctgtcggagcagttctgcttagctccctccccatttctccacagtacggg

SEQ ID NO: 1643 - DNA, 230 bp, Homo Sapiens
  Substantia nigra
  sig_peptide 24..167: Von Heijne matrix; score 5.20; seq EVVTLPLTSHCLA/QV
atgaatttctaaaactcttttttatgggacttcacatttctctgattaaatttcttcttgctaatggaccccatattcctagtcaccaaagaccttttgaacctaaaggggaaaaaagctgcagaattgaagtggtgactctgccacttactagccattgtcttgcccaagttgcaagttctgacctcatccataggatgagaaccataacaggtacctcgtcacacggg

SEQ ID NO: 1644 - DNA, 349 bp, Homo Sapiens
  brain
  sig_peptide 158..235: Von Heijne matrix; score 5.10; seq LLTLYVFVASSMQ/IY
atacatggaggcatgtaatgaatactgaatgaataaattattaaaacctcaagcttattctaggcttaagctctggttctcaataaaatactaccaaataaacataaaaatacgtacttactttagagcattttgaaagtacataacttaaggaaaaatgaaaactacctatgtaatatttatgcaaagcaaagcactattaacattgtatgtatttgtagcctcttctatgcaaatttatgtattacacatttcaaattacccaacagatgagcattttcctatcattaagcatttttattttacttttaaaatccactttagtaaaattatttatgtgcagtacagt

SEQ ID NO: 1645 - DNA, 142 bp, Homo Sapiens
  brain
  sig_peptide 68..112: Von Heijne matrix; score 5.10; seq ALVFLIFLRFINI/SE
aattactcccttcactggaaagaataaaatattaccacataaattcgtattatgataatggcccactatgaatgctttggtgttcttaattttcttaagatttattaatatttctgaagtaactactaaatgccaagcaggg

SEQ ID NO: 1646 - DNA, 190 bp, Homo Sapiens
  Substantia nigra
  sig_peptide 86..172: Von Heijne matrix; score 5.10; seq WGFLLTGHSLSHS/SK
aattccatctcagttgctggtttcacaggcaggaccacccctgggcgcctctgtcccccggtcggggagtctgatcctgcctcccatgcagctgggtccccttcacactgtgtctacaccctttttcttctgttggggttttctcctcactggccattctctttcycactcctctaagtcctgccacctg

SEQ ID NO: 1647 - DNA, 226 bp, Homo Sapiens
  brain
  sig_peptide 41..211: Von Heijne matrix; score 5.10; seq VGSVCCCVGPLRG/LV
ctctaggactggcttggtggaggtbratgaaggccgtgagatggggcgggggtgggagaggacagtttgcagccttgggtggcgcgggggcccagaccctctgtcttgggccacttgttggtcgggagccagatctcgccacacccgcgtttcctcgattgtaaacggttatgttgggagtgtttgctgctgcgtgggtccgctgagaggattagtctgggcccct

SEQ ID NO: 1648 - DNA, 195 bp, Homo Sapiens
  Substantia nigra
  sig_peptide 115..180: Von Heijne matrix; score 5.00; seq HLFVTWSSQRALS/HP
aacctgccagtkatgcaaatgccaaaatgtgggtcatcatatagtatatttgaaacctttctgaacatgtacaccacccaatgctagaggctgacttggaaaccggtgggtgcaatgcccgaggctgtggaacaatcagcccatctctttgtgacctggagcagtcagagggccctcagtcaccccgccccattg

SEQ ID NO: 1649 - DNA, 386 bp, Homo Sapiens
  Cerebellum
  sig_peptide 240..311: Von Heijne matrix
  score 5.00
  seq CWLIALSVPLVFW/VT
  misc_feature 139: n=a, g, c or t
  unsure 20: position 20 of amino acid sequence; Xaa = Ala,Thr
aatttgtttagaaacatgcctttcattaatgtaattccctgcatttacagatagacaatctgagccaggactagcagtccaggattcckgatgtcttaccttgtccttaactctgataccatcctactgaccaaagttngcacttctttggacttttttagagactaccaaatgggctttgacacgttcatttggaatacatcaagccttaatatttatatcttatatcattgaacataatgcctggcacacacacgtttacttttaaaagctgctggcttatagctctttctgtgcctttggtcttttgggtgacattctggccgtgtaacttttatccgtcccttgacttctgcatgttaactaagrctaagagcatattcata

SEQ ID NO: 1650 - DNA, 197 bp, Homo Sapiens
  Substantia nigra
  sig_peptide 69..134: Von Heijne matrix; score 4.90; seq LFCLIGLDLLCQV/FS
ataaatctcacaattagaattgcataattgattcacatcaataatagacctatatttgatgttcagctatgcttttactgactttcaaatggtttctgttttgcttaattggtttggatttgctctgtcaggttttttccccttatttccttagtgagaaagttgcagacctgctgttttatatgtctctgtttttt

SEQ ID NO: 1651 - DNA, 169 bp, Homo Sapiens
  brain
  sig_peptide 5..160: Von Heijne matrix; score 4.90; seq VPNLHLLLPLTTP/QP
attaatggcaacyacaggcagacggcaggctgaacctccgcccgtccggcccgcccattcccgacctccacctagggtgcctgggagcagcagtctagggctggcaggacttatgtcccccgtccccaaccttcacctactcctcccccttactactccccaacctcgg

SEQ ID NO: 1652 - DNA, 185 bp, Homo Sapiens
  Substantia nigra
  sig_peptide 27..74: Von Heijne matrix; score 4.90; seq FIYLQAHFTLCSG/WS
aatagataggagagcaagcctcaccaatggttcccttcatctatctgcaagcccactttacactctgttctgggtggtccagcacataccgggacctccggaagggtgtgtatgtgccctacacccagggcaagtgggaaggggagctgggcaccgacctggtaagcatcccccatggcccaaag

SEQ ID NO: 1653 - DNA, 239 bp, Homo Sapiens
  Substantia nigra
  sig_peptide 150..191: Von Heijne matrix; score 4.80; seq FFSFLLTINLVSL/QV
ataacattacagtttgggctcttggtgcccaatgattgatttatctatagtatagatttatttctcacagtacctcttggaatgctcatttttaaccccaatagttaaatttgccttggtaagctacaaaaacaggcaccaaagcagcaatgttttttagttttctgttgaccataaatctcgtttctttacaagtagtaattctaaacagagtataccttaaccagccagatgcacgg

SEQ ID NO: 1654 - DNA, 168 bp, Homo Sapiens
  Substantia nigra
  sig_peptide 100..162: Von Heijne matrix; score 4.80; seq NWGLLCFASECTT/DR
agaggattggagaggaagagttggattccagaaatatgcaggaggtggccgcaggaattgggagataaggcagagggaagaggccatgcccagtttctgatgtggcctgggcgtgaatgcaaaaattggggtcttctgtgctttgcaagtgagtgcaccaccgatcgg

SEQ ID NO: 1655 - DNA, 238 bp, Homo Sapiens
  brain
  sig_peptide 113..223: Von Heijne matrix; score 4.80; seq CLLLTLRQPPTHS/GI
aagtttatttatcaagtgaaatagggttagtactaccagtctcataaggttattatgagataccaaatggaaatctaaagaagatcyttgcaccatagtatgtgatcagtgaatgttaactcctttctccttggaggagaaacttctagaatgtcattatgtacttgcaaaactagctggggcatgtctcctgttgactctaaggcagccacccacacattctggaatcccacacggg

SEQ ID NO: 1656 - DNA, 204 bp, Homo Sapiens
  Substantia nigra
  sig_peptide 79..198: Von Heijne matrix; score 4.70; seq IVFVGLIFLKSSA/HR
atgattgmgggattgtgtagaggtgattttgaagatggaagacttgtgcactgaagaaaatgagaaaaatgagaagaaatgaaaagaataaaatcaatgatgggaaaagttgaacatataaagattaaaggagaaaaacaaagaagccgtcatgtaaaaatagtatttgttgggcttatttttctaaaaagcagtgcacatagg

SEQ ID NO: 1657 - DNA, 136 bp, Homo Sapiens
  Substantia nigra
  sig_peptide 29..79: Von Heijne matrix; score 4.70; seq LCLFCKICPFTHG/VA
aaccagaaactactttgcatcccattgaatgcaatctgctctgtgcctcttttgtaaaatctgcccatttacacatggtgttgccaccccagcctgggaactgagcagcaagaggaaagcttcccacccgccccgg

SEQ ID NO: 1658 - DNA, 387 bp, Homo Sapiens
  Surrenals
  sig_peptide 112..318: Von Heijne matrix; score 4.70; seq SLLCLAFLLGRFL/HM
agctagtagcagctctggcagaagcaacggtggcttcgagggatggcggcggctgcaacaggacctgcagcatcccagaggaactgactaagactttggaacagaaaccagatgatgcacaatattatcgtcaaagagcttattgtcacattcttcttgggaattactgtggtgcagatgctaatttcagtgactggattaaaaggtgtcgaagctcagaatggctcggaatctgaggtgtttgtggggaagtatgagaccctcgtgttttactggccctcgctgctgtgccttgccttcctgctgggccgcttcctgcatatgtttgtcaaggctctgagggtgcacctcggctgggagctccaggtggaagaaaaatctgtcctg

SEQ ID NO: 1659 - DNA, 324 bp, Homo Sapiens
  Substantia nigra
  sig_peptide 19..99: Von Heijne matrix; score 4.60; seq RLLCSRLCQQLRS/KR
atcatctgaatcttaatcatgtccaactgcctgcaaaatttcctgaaaattacaagcactcgtcttctatgttcaagattatgccaacagttaagaagtaaaaggaagtttttcggaactgtgccaatatccagattgcataggcgagttgtcattacaggcattggcttagtgactcctcttggtgttggaactcacctggtttgggatcgtcttatcggaggagagagtggaattgtttcactggttggtgaagagtataagagtatcccttgcagtgttgctgcttatgtgccaagaggtagtgatgaaggtcagtcaggg

SEQ ID NO: 1660 - DNA, 241 bp, Homo Sapiens
  Cerebellum
  sig_peptide 74..121: Von Heijne matrix
  score 4.60
  seq XGLFLRTTAAARA/CR
  misc_feature 83: n=a, g, c or t
  unsure -13: position -13 of amino acid sequence
  unsure 33: Xaa = Ala,Pro,Ser,Thr; position 33 of amino acid sequence; Xaa = Glu,Lys
aatcagacgtgtgtgtgtccctgcggcgctaagaaggggagactgaggctgmggctggggaacatcgggcagcatgagcggcncmgggctcttcctgcgcaccacggctgcggctcgtgcctgccggggtctggtggtctctaccgcgaaccggcggctactgcgcaccagcccgcctgtacgagctttcgccaaagagcttttcctaggcaaaatcragaaggtaacgcgagccctgggc

SEQ ID NO: 1661 - DNA, 207 bp, Homo Sapiens
  brain
  sig_peptide 112..186: Von Heijne matrix; score 4.50; seq LTWLHLLLSHLKS/SL
accttcccaccacccgcaggagcacctgcctccattcacaaccgccgacactactgcagcctcatcctaactgaccttggcttctctgggagacccttcctgcaccctgaaatgaatcctctgcacaagcactgtgctgcaggacccctcacctggctccacctcctactttctcacttgaagtcttctcttgtaatgcctccaaag

SEQ ID NO: 1662 - DNA, 143 bp, Homo Sapiens
  brain
  sig_peptide 18..104: Von Heijne matrix; score 4.50; seq FAVLRVLHLPALT/AP
aacacatcttccctgagatgcctaaggacaaaagaggagctagacacaactctccccatttttcctttgctgtcttaagagtgctccatcttccagcactgactgcccctctgtggctggctcctttctctaccctccccagg

SEQ ID NO: 1663 - DNA, 269 bp, Homo Sapiens
  Substantia nigra
  sig_peptide 126..242: Von Heijne matrix; score 4.50; seq LCVSRQLLTGART/LF
aagaacaagcagctgacatgattgctgtcggtgttcacagagccaaatatgaagataattgtaaagaaagagacggtcgcatcggatagaagatgtgatcctgctctcacgtttttccttctggcatgaccatacacgttttgagaaaatgttgccaaatgggtagactaaacaatgaatggctgccgggtttagtcatacctctctgtgtgagccgtcaattgctgacgggagctaggacattattccagctacaaaatgggcccgcg

SEQ ID NO: 1664 - DNA, 348 bp, Homo Sapiens
  Substantia nigra
  sig_peptide 253..342: Von Heijne matrix
  score 4.50
  seq IAALLGLLQLRFK/AE
  misc_feature 112: n=a, g, c or t
gtccagattgggccacttctttctcagctctaatgactttcctcagttccgtgggttactcctgccaactcgacgccggccgccatgacactcgctcggaaagcggcagcgnatcatagaaaagcgccgcggtggcgtagacaggccccgcgaascgccggacgtgtccttggcgcaagggaggctgggatcgcggaggaccgagcgcgggctggattaaccgcagccagtgcctagcgcaaggttaggtgcatgcaggcggccagcttcggccggggaaggaatggcctggataactggggcatcgcggcgctcctcggcctcctgcagctgcgtttcaaagcagag

SEQ ID NO: 1665 - DNA, 465 bp, Homo Sapiens
  Substantia nigra
  sig_peptide 310..438: Von Heijne matrix; score 4.50; seq ENLLLCCHRCTNC/QR
aaggttctttctcatttgtgtaggtggatgttccttcaatctttgaagttgctgtcccttggatggatttttgttgctttcatcttctttgatgcccttgggggcttgattgtggtataaggtaggttcagmhaactcatttaagktcgcttttccaggagtcactggggaccaggaatgagtcctggtgcatggtaatcccatgcagagttcccagccatccctctgtcagcccagcacctgtgtcttcccacatccactgtcaatgccttccctctgagatttgctcagagtgcgcctgtcttcgcaatgtccccatctcttggtgacagatgttcctcttggctgcatctagtcagccatcttgaatcaatctctggacctctacttaatatccctgagaatctccttctctgttgtcaccggtgcaccaactgccaaagacaccatttttgcagtgtttgg

SEQ ID NO: 1666 - DNA, 141 bp, Homo Sapiens
  Cerebellum
  sig_peptide 1..72: Von Heijne matrix; score 4.40; seq YFLLPCLINLAIG/VK
atgtcaggagctgagccaacaaccttcatcagatattttcttcttccatgtctcataaatttggccattggagttaaatggaaaacagcttggaagaggggggaaaggcagctaaacaacactgtcttttttttttttttt

SEQ ID NO: 1667 - DNA, 186 bp, Homo Sapiens
  Substantia nigra
  sig_peptide 91..156: Von Heijne matrix; score 4.40; seq QLLFSFLLSTIPT/SY
atgttactaggcaataggagtttttgaactgcattataatcttatgagaccaccatcatatatacagtttgttgttgaccaaaacgttatatggtgtatgactattttatttcccaacaactgctgttctcttttttactctctactatccccacatcttaccacctttcccttacttgccagcgg

SEQ ID NO: 1668 - DNA, 332 bp, Homo Sapiens
  brain
  sig_peptide 261..302: Von Heijne matrix; score 4.30; seq LFLCSCSLSLNQL/LT
aaatcagattcacctaaaacggagatcatttatagaaagaaaaaaacacaaaggtcttctgttgaactgttcagtaagtgtgtactgatacaataatatggcaggatattgggtttccaactcagagttgatagttcagaattaaattttggcctatgtcttgctttttagctttttaagccattctgacgctaccatagacatgcccatctggtagatgagaaattcaggtgtagaaagacttgcagaaatcttatgagatgctctttctttgttcctgttctctttctctgaaccagctcctaacttacatctttgtagtcccaccctgg

SEQ ID NO: 1669 - DNA, 187 bp, Homo Sapiens
  brain
  sig_peptide 122..166: Von Heijne matrix; score 4.20; seq FLMVLLFRSNKWT/GK
aaagaaaatgaacccctgtaaagcaatttcagcttatgaacccctgtaaagcaatttcagctttgcttcatggtatatttgctttctatccagaggttaatttgttagttttcttaaaacaatgtttttcttaatggtcttattgtttagaagtaacaagtggactggaaaagtatacggggccctg

SEQ ID NO: 1670 - DNA, 200 bp, Homo Sapiens
  Substantia nigra
  sig_peptide 78..164: Von Heijne matrix; score 4.20; seq FLSHVTTSLASSS/AP
acaactaccactctctgttctgttcactccgttccagccacacccaccttcttgctgttctttgaacatggcctggcatgctccctcttcagggcctttgcacttgttatttcctccacctagaatttctttcccatgtaactacctcacttgcttcatcatcagctccctcacctaaaccttcagtaaccctttcttcg

SEQ ID NO: 1671 - DNA, 276 bp, Homo Sapiens
  Substantia nigra
  sig_peptide 205..267: Von Heijne matrix; score 4.20; seq HFFLLLNTILLFG/CA
acagagaattgttccactacactaaaaatcccatgtgctctgcttattcatccctccttctctccctctagcccctgacaaccactgatgtctttactgtctccctagttttgctttgcccagaatgttatatagatggaataatatagtatatattttcacattggcttcattcacttagatacatgtctttaaggttccttcatgtatttttatggcttgacatttcatttcttcttattgctgaatactattttattgtttgggtgtgcccgg

SEQ ID NO: 1672 - DNA, 271 bp, Homo Sapiens
  Substantia nigra
  sig_peptide 152..238: Von Heijne matrix; score 4.10; seq LWASQGSLQDAQS/ER
actctattatctcggcttctcgggaggagcctcatctagtcagtcacgcagaagtttctctttcgctcttcgcgctacacacccagattggcttccagcgcgcaggtaaaacctggctgtgccctgttgaaatcaattctgttgcagtcatatgcggtggaatctgttcttcttttgcatcctacgtaaccagaccaagctgtgggcttctcaaggtagcctccaggatgcacagagtgagagaggatgcttttccctaaaccaggatggg

SEQ ID NO: 1673 - DNA, 245 bp, Homo Sapiens
  brain
  sig_peptide 150..191: Von Heijne matrix; score 4.10; seq FIAALFTMAKTWN/QP
agtgtaaattagttcaaccattgtggaagatagtgtggcgattcctcaaggatctagaaccagaaataccatttgacccagcaatcccatcattgggtatatacccaaaggattataaatcattctaatataaaaacacgtgtacgcatatgtttattgcagcactattcacaatggcaaagacttggaaccaacccgggtgctcatcaatgatgggctggataaagaaaatgaggcacatgacg

SEQ ID NO: 1674 - DNA, 207 bp, Homo Sapiens
  brain
  sig_peptide 25..156: Von Heijne matrix
  score 4.10
  unsure -41: seq LWVXLPXXXVIAS/VV
  position -41 of amino acid sequence
  unsure -32: Xaa = Pro,Ser
  position -32 of amino acid sequence
  unsure -29: Xaa = Lys,Thr
  position -29 of amino acid sequence
  unsure -23: Xaa = Leu,Met,Arg
  position -23 of amino acid sequence
  unsure -22: Xaa = Gly,Trp
  position -22 of amino acid sequence
  unsure -10: Xaa = His,Lys,Asn,Gln
  position -10 of amino acid sequence
  unsure -7: Xaa = Ser,Trp
  position -7 of amino acid sequence
  unsure -6: Xaa = Phe,Leu
  position -6 of amino acid sequence
  unsure -5: Xaa = Met,Val
  position -5 of amino acid sequence
  unsure 6: Xaa = Ala,Val; position 6 of amino acid sequence; Xaa = Gly,Val
attacatyaaatktatcaaaatgyatgccygggycaaagcattttctcagagtgttcagaamatccgcgmkgaggagcgtcggatatkggmamaagccgggtacttccagagcatcactgtgggtrtsgctcccattsrtggysgtgatygccagcgtggtgaccttctctgkkcatatgaccctgggcttcgatctgacagcagcg

SEQ ID NO: 1675 - DNA, 269 bp, Homo Sapiens
  Surrenals
  sig_peptide 30..176: Von Heijne matrix; score 4.10; seq VALGPLFVTGHFA/GE
aaggctcccctttcggcctctcgttctttatgcgacttgaatctcccgacgaaaattttgcggtagttcaggaacatgccattcatcacatcgatggcccgctccgcagattcctgcttttggaagtgcacgaacccgtagcccttgggccccttttcgtcacaggccactttgcaggagaggatgttgccgaacgccgagaagatgttgtacagcgccttgttgtcgatggtcttgcccaggttcttgatgaagacgttgcccacccg

SEQ ID NO: 1676 - DNA, 249 bp, Homo Sapiens
  Cerebellum
  sig_peptide 175..234: Von Heijne matrix
  score 4.00
  seq EVLLPTVLRGSYC/FS
  misc_feature 140: n=a, g, c or t
acattaatcaactgtgaaatacagagcaggtcacttcacctctcagtgtgtcctcattttaaaaatcagaccgtaacagtagctatctcawtagggttgttaggaggtgtactgtattaggatgttaggccttatacawnagaagaaaacggaacagtgacgtaaacaaatttgatggcagggagtccagatagggaggttctgctcccgacagtcctcagaggctcatattgtttctcccaccatggg

SEQ ID NO: 1677 - DNA, 198 bp, Homo Sapiens
  brain
  sig_peptide 10..165: Von Heijne matrix; score 4.00; seq RHLFLFEISLVFS/KE
aatgatgccatgcatgtcagcatgctggaagggttcgacgagaacctggatgtgcagggggagttgattctccaggatgcctttcaagtgtgggacccgaagtcgctgatccggaaggggcgggagcggcacttgttcctctttgagatctccttggtttttagcaaggagatcaaagattcttcagaacacaacggg

SEQ ID NO: 1678 - DNA, 306 bp, Homo Sapiens
  Substantia nigra
  sig_peptide 112..228: Von Heijne matrix
  score 3.90
  seq VLAIGLLHIVLLS/IP
  misc_feature 107,146,167: n=a, g, c or t
  unsure -28: position -28 of amino acid sequence
  unsure -21: Xaa = His,Leu,Pro,Arg
  position -21 of amino acid sequence
  unsure 7: Xaa = Ala,Asp,Gly,Val; position 7 of amino acid sequence; Xaa = Pro,Arg
agcagccgcgggttgttacagctgctggagcagcagcggcccccgctcccgggaaccgttcccgggccgttgatcttcggccccacacgaacagcagagaggggcanmaggatgaatgtgggcacagcgcacagcgaggtgaaccncaacacgcgggtgatgaaggnccgtggcatctggctstcctacgtgctggccatcggtctcctccacatcgtgctgctgagcatcccgtttgtgagtgtccstgtcgtctggaccctcaccaacctcattcacaacatgggcatgtatatcttcctgcac

SEQ ID NO: 1679 - DNA, 433 bp, Homo Sapiens
  brain
  sig_peptide 371..418: Von Heijne matrix
  score 3.80
  seq FVXAIXXYIPTNS/VQ
  misc_feature 386,398: n=a, g, c or t
  unsure -11: position -11 of amino acid sequence
  unsure -8: Xaa = Leu,Met,Val
  position -8 of amino acid sequence
  unsure -7: Xaa =  * ,Glu,Gly,Leu,Val; position -7 of amino acid sequence; Xaa = Phe,Ile,Leu,Val
atttcttctatgtcttgtttatttcacttagcataatgtcctctaggttcactcatgctgtcacaacttggcaggattttcttcttttttaaggcttgaaaatattccattttgtgtgtatatgtgtatgtatgtatacatacacacacacatacacaagcacacatacactataatttcttaatccattcaactattgatcgatacttaaattgattccaaatcttggctattgtgaataatgctgcaatgaacatgggagtacagatatctcttcaacatactgagttcaaatcttttgggtaaatacccagatgtgggattgctggatcatatgataattctatttttaattttttgagtgacvtccatgctatcattcgtantggctatakdantttacattcctactaatagtgtacaagaattcctt

SEQ ID NO: 1680 - DNA, 403 bp, Homo Sapiens
  Substantia nigra
  sig_peptide 284..379: Von Heijne matrix; score 3.80; seq TFINITLWLGSLC/QR
acagctggggctttgtcttctttattgctaggagaatgtagcaatagaagttctcatcgccctgtattgcacttttggttttaaggactggacccagagttcctgaaagccaaactccataagctgctcagtaagttccaagcacatagccggctkhgggatgcgattcggtcgaggtctgttgaatgaaggtagacgcagcaggcagtttgtccttaccagtgacctggaagacggtggcacttcctgagtgagctcacttaccttccctgaatggtgaggcatggatgaatattcctggtggtgccacgtgttagaggtggtaaagggtcaaatgtttacttttattaatattacattatggcttggttctctgtgtcagcgatttttctatgcctcgggt

SEQ ID NO: 1681 - DNA, 181 bp, Homo Sapiens
  Substantia nigra
  sig_peptide 95..163: Von Heijne matrix; score 3.80; seq FIFLIQIWKTCLS/FS
acatgatggatgaatgatgttatctttcacatgtggctttcttgccttgtcctaagtgcctgctgtagtcgttgacattttccagcaaacaggaatgaggagaaaaggtcaaggacatctagcctttatcttcctgattcagatttggaaaacatgcctttcgttttctcccacctctggg

SEQ ID NO: 1682 - DNA, 129 bp, Homo Sapiens
  brain
  sig_peptide 37..111: Von Heijne matrix; score 3.80; seq NILFLAVSSFSMP/LP
aatattgtaaggtaccttattccttagtggtatggaatgtttttaatcagtggacatgtgcatttaatttataacatcctgttcctggcagtatcgtctttttccatgcccctgccctgcctctacagg

SEQ ID NO: 1683 - DNA, 332 bp, Homo Sapiens
  brain
  sig_peptide 99..290: Von Heijne matrix
  score 3.80
  seq LFIVVCVICVTLN/FP
  misc_feature 302: n=a, g, c or t
  unsure 4: position 4 of amino acid sequence
  unsure 5: Xaa =  * ,Phe,Leu,Ser,Tyr; position 5 of amino acid sequence; Xaa = Asp,Tyr
attggattagtagaattgcttttgtcattccattgttttcatatatttgtttgggacattttacttttttctgttaacgcttaccctagraattagaaatgacaccacgtattcttagcgaagtccagttttcagcattttgtccttattggacaatagcaaggatattagaacgtgttggttccgcgtgcttccgtcttgagttatgtgctgctattgtcggatattttgtcttagatgtacgtactttcctgttcattgtggtatgtgtaatttgcgttactttgaattttccacgtthnkactttctttgtctctcatcacttaccgcg

SEQ ID NO: 1684 - DNA, 225 bp, Homo Sapiens
  Substantia nigra
  sig_peptide 25..66: Von Heijne matrix
  score 3.70
  unsure 14: seq CSLLSGWGQLLRC/VQ; position 14 of amino acid sequence; Xaa = Leu,Pro,Arg
aagtggtcccaggaccactcatggatgtgtagtttgctgagtggctggggacagcttcttagatgtgtacagaccccagcagagcccagagatgtaaacaagaagcbagaaaaaaaggaaaagtacatgcccctggtagattccctctgtggagggttaggaactaggaatagtgactgcctcagagggggagctggcaggggcagagatgggagaaggataagg

SEQ ID NO: 1685 - DNA, 281 bp, Homo Sapiens
  Cerebellum
  sig_peptide 144..254: Von Heijne matrix; score 3.70; seq LIPFNFSASGLCA/CS
atattgtcactaaatttagtggccatgtctccatccttctaacctgtctggccttcttagtaatacattgcatgggctaacttgttttttttggaamawgcmsatvsattkgaackkcttcaaatcagtaccccctggcctcvatgctgttttctttctgcttcccagttcatttctggaacccaagttcactctttcccccaagttcagtttctttgatcccctttaatttcagtgcatctgggctgtgtgcttgttctagraccttcacacacatgggt

SEQ ID NO: 1686 - DNA, 364 bp, Homo Sapiens
  brain
  sig_peptide 284..328: Von Heijne matrix
  score 3.60
  seq WILRILFVIGSXL/EK
  misc_feature 124,202: n=a, g, c or t
  unsure -2: position -2 of amino acid sequence; Xaa = Lys,Asn,Arg,Ser
atgactgccatttgaagtggctacttcaatggttggttgataataactttcaacattctgtgaatgtaagctgtgcacaccctgaatggctagcagggcaaagcatcctgaatgtggatctganagatttwrtctgtgatgattttctcaagccacagataaggacacatccwgaaaccataattgctctaagaggcatgantgtgactctgacgtgcactgcagtgaagcagmagtgattcacccatgtccactgtgtggcgcaaagacagtgaaatcctgtatgacgtggatactgagaattttgttcgttattggcagcardctggagaagctctggaatatactagtatcttacatcttt

SEQ ID NO: 1687 - DNA, 290 bp, Homo Sapiens
  Substantia nigra
  sig_peptide 123..266: Von Heijne matrix
  score 3.60
  seq ILCIFLGLLIIRC/FK
  misc_feature 283: n=a, g, c or t
  unsure 6: position 6 of amino acid sequence; Xaa = Ala,Asp,Glu,Gly,Val
agacaaacgtgccaacacttaagtctactggctggacttcatctccatggcaacaagcatggaaggcaaagagttgattccagaaggaactgtgaagagccacaacaatgtgccagtgaataatgagtagtacctactgtggcaactcttcagctaagatgagtgtcaacgaagtatcagctttctcattgagtctggagcaaaaaactggctttgcttttgttgggattttgtgtatcttcttgggacttcttattatccgatgcttcaaaatcctgctagnscaatcg

SEQ ID NO: 1688 - DNA, 208 bp, Homo Sapiens
  Substantia nigra
  sig_peptide 143..196: Von Heijne matrix; score 3.60; seq LTMLSMIVGATCY/AM
agctgcaggacttcccgcgcaactgctgggtgtccatcaatggcatggtgaaccactcgtggagttaactgtactccttcgcactcttcaaggccatgagccacatgctgtgcatcgggtacggccggcagsgcccgagagcatgacggacatctggctgaccatgctcagcatgattgtgggtgccacctgctacgccatgatcggg

SEQ ID NO: 1689 - DNA, 214 bp, Homo Sapiens
  Substantia nigra
  sig_peptide 59..109: Von Heijne matrix
  score 3.60
  seq WIYAFISLGYILG/SG
  misc_feature 65: n=a, g, c or t
  unsure -16: position -16 of amino acid sequence
  unsure -15: Xaa = Arg,Ser; position -15 of amino acid sequence; Xaa = Phe,Ile,Leu,Val
aagtttgggttgtttctgcttttcgttaaaaatagtagtacttctctgaacactgtggatgaghntttgctggatatatgctttcatttctcttgggtatatacttgggagtggaattgttgggttatttggtaattttatgtttaaacttttgaggaactgccagaccgttttccaggatggctatgctatattacccttcccaccaacgggg

SEQ ID NO: 1690 - DNA, 156 bp, Homo Sapiens
  Substantia nigra
  sig_peptide 19..111: Von Heijne matrix
  score 3.50
  unsure -4: seq QLALSWVPPXCRV/SP; position -4 of amino acid sequence; Xaa = Asp,Gly,Asn,Ser
acttttaggcccattgggatgttcattagaactctgaaaactacagttctcccctttatgaggactgcaccacagctcgccctctcctgggttccgcctrrttgcagagtgagcccatgggacagccctctgaaattatactgcttacaaccgcag

SEQ ID NO: 1691 - DNA, 297 bp, Homo Sapiens
  brain
  sig_peptide 211..282: Von Heijne matrix; score 3.50; seq SVLIFCLLPYIYH/FF
ataaaaataatttatatttgatgttataatacattatttaatttttatagtaaattcactaatctgttttgtttagaccagkrtgagagaaaagssagactkcgagttaatactttgtaaggttatctgcactctcatctgtggttggcaatatttgatgcagtttatattagatttatgttgttgttatttagatagtttggagctgagatgaggacaggagctgagatgaggacaaactcttcagttttaattttttgtttgctcccatatatttatcatttttttccagcttcg

SEQ ID NO: 1692 - DNA, 310 bp, Homo Sapiens
  Substantia nigra
  sig_peptide 146..214: Von Heijne matrix
  score 3.50
  seq EGLELGFSHRTFA/FP
  misc_feature 13..14,36,38,258: n=a, g, c or t
  unsure 15: position 15 of amino acid sequence; Xaa =  * ,Cys,Phe,Leu,Ser,Trp,Tyr
atagggcaattannggctcatctcatttgtttccwnwnctctcaggggccacagccctgcattacctgtttgccaatgtgtgaaagcaattgtttcatgtattttgcccagttttctagtttcttatggcaggaagttaagtccaatgattgttattccatcatggctggaaaacgagggtctggaattgggattttcacataggacctttgcttttcctgtgacacatgcttcctctcagtacatatggatgaactnkctgactaggactacagtagcaatatcagtttatttttggacccacacaggg

SEQ ID NO: 1693 - DNA, 409 bp, Homo Sapiens
  brain
  sig_peptide 266..394: Von Heijne matrix; score 3.50; seq VISVFLSFLPSYP/GF
acaaatctaaatctaaagataattttcaagtttggccagggaatccttatgttatattgattccataaaaacaggggtatgtattacctagcagctgaagaagagatggcctacattaggcacctgagtgtcagaaggggttgtcaagaaagtgtacagttaatacataagtctgtcctgattgaattaattaatcaagaactacaggtgttgaaaagagaaatgggtacctggagaagggcatcatctatattggcatcttggaatgttaaaaaaggaaatagctcaccacagccctagcctggtgagctgccctgtctgcaccacaaaatatagaactctgagactcctgagggttatctcagtttttctgtcttttcttccttcttacccagggttcagcatgcaa

SEQ ID NO: 1694 - DNA, 343 bp, Homo Sapiens
  Substantia nigra
  sig_peptide 248..337: Von Heijne matrix
  score 3.50
  misc_feature 112..344: seq CAYSLPGVALTLG/RQ; blastn; identity 94; region 36..268
  id AA256780
  unsure -28: est
  position -28 of amino acid sequence
  unsure -19: Xaa = Asp,Glu,Gly; position -19 of amino acid sequence; Xaa = Arg,Ser,Thr
tgatcggaccatttcactgcagcaagcaacacagtattctgagcagaagatcgggacttgaggccatgttgcggagggccagtgacattatctggactctggagtgtgrrgraatatbgastccackcttcactatattcacagcgattcagacttgagcaacaatagcagttttagccctgatgaggaaaggagaactrragtacaagatgttgtacctcaggcgttgttagatcagkatttatctatgactgrsccttctcgtgcacagacggttgacaskggaattgctaagcactgtgcatatagcctccctggtgtggccttgacactcggaagacag

SEQ ID NO: 1695 - DNA, 151 bp, Homo Sapiens
  Substantia nigra
  sig_peptide 71..133: Von Heijne matrix
  score 9.80
  misc_feature 52..133: seq LGLLCALLPQHHG/AP; blastn; identity 90; region 55..136
  id W81722
  misc_feature 90..150: est; blastn; identity 90; region 1..61
  id R67182
  misc_feature 80..114: est; blastn; identity 97; region 1..35
  id R57498
  misc_feature 20..50: est; blastn; identity 90; region 297..327
  id N21080
  unsure 6: est; position 6 of amino acid sequence; Xaa = Gly,Trp
agcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgaykgg

SEQ ID NO: 1696 - DNA, 244 bp, Homo Sapiens
  Cerebellum
  sig_peptide 134..187: Von Heijne matrix
  score 9.20
  misc_feature 68..245: seq VFLCSLLAPMVLA/SA; blastn; identity 96; region 1..178
  id T08712
  misc_feature 79..245: est; blastn; identity 95; region 2..168
  id R88049
  misc_feature 80..154: est; blastn; identity 96; region 1..75
  id AA094697
  misc_feature 170..202: est; blastn; identity 90; region 89..121
  id AA094697
  misc_feature 112..245: est; blastn; identity 91; region 35..168
  id H30765
  misc_feature 79..121: est; blastn; identity 97; region 1..43
  id H30765
  misc_feature 112..245: est; blastn; identity 93; region 21..154
  id H38484
  unsure -17: est
  position -17 of amino acid sequence
  unsure 7: Xaa = Glu,Gln
  position 7 of amino acid sequence
  unsure 8,10: Xaa = Glu,Lys; position 8, 10 of amino acid sequence; Xaa = Asp,Glu
aaggasgcaggggaggcgggaaagcagctcaagcctcacccaccgccctgcccccagccccgcsactcccaggctcctcgggactcggcgggtcctcctgggagtctcgsaggggaccggctgtgcagacgccatgsagttggtgctggtcttcctctgcagcctgctggcccccatggtcctggccagtgcagctgaraaggagraggamatggasccttttcattatgattaccagaccctg

SEQ ID NO: 1697 - DNA, 281 bp, Homo Sapiens
  Substantia nigra
  sig_peptide 15..104: Von Heijne matrix
  score 9.00
  misc_feature 52..283: seq FFLLLLFRGCLIG/AV; blastn; identity 90; region 1..232; id AA111270; est
aagcaaccctcgacatggcgctgaggcggccaccgcgactccggctctgcgctcggctgcctgacttcttcctgctgctgcttttcaggggctgcctgataggggctgtaaatctcaaatccagcaatcgaaccccagtggtacaggaatttgaaagtgtggaactgtcttgcatcattacggattcgcagacaagtgaccccaggatcgagtggaagaaaattcaagatgaacaaaccacatatgtgttttttgacaacaaaattcagggagacttggcg

SEQ ID NO: 1698 - DNA, 461 bp, Homo Sapiens
  Substantia nigra
  sig_peptide 123..302: Von Heijne matrix
  score 7.20
  misc_feature 105..234: seq VLLTLLLIAFIFL/II; blastn; identity 97; region 1..130
  id N77056
  est
  misc_feature 373,432,434: n=a, g, c or t
  unsure 3: position 3 of amino acid sequence
  unsure 24: Xaa = Ile,Met,Arg,Ser,Thr
  position 24 of amino acid sequence
  unsure 27: Xaa = Ala,Glu,Gly,Lys,Leu,Met,Pro,Gln,Arg,Thr,Val
  position 27 of amino acid sequence
  unsure 44: Xaa = Cys,Phe,Leu,Ser,Trp
  position 44 of amino acid sequence
  unsure 45: Xaa =  * ,Cys,Asp,Glu,Gly,His,Lys,Asn,Gln,Arg,Ser,Trp,Tyr; position 45 of amino acid sequence; Xaa =  * ,Cys,Phe,Ile,Leu,Arg,Ser,Thr
aaagtaatctttatttcgtcatttttgaracatagaagccgtaacggaagcaagtgaaatgctcagtcttagacgactgcgtcgtgctatgaccggactttttcttgaaaggggatgacagcatgggaggcaatggctccacatgtaaacccgacactgaaagacaaggcactctctccacagcagccccaacaactagccctgcaccctgtctctctaaccaccacaacaaaaaacatttaatccttgccttttgtgctggggttctactgacactgctgctgatagcctttatcttcctcatcataabbagctacagaaaatatcactccaagccccaggccccagatcctcactcagatcctccagcgvngctttcatbsatcccaggggaaatcacttacctatgccagcacaactttcaaactctynrnwbwaaaagagcaatcacttggctgaga

SEQ ID NO: 1699 - DNA, 380 bp, Homo Sapiens
  Cerebellum
  sig_peptide 90..206: Von Heijne matrix
  score 7.20
  misc_feature 233..381: seq SALAKLLLTCCSA/LR; blastn; identity 91; region 157..305
  id N78069
  misc_feature 72..129: est; blastn; identity 94; region 1..58
  id N78069
  misc_feature 117..180: est; blastn; identity 90; region 45..108
  id N78069
  misc_feature 173..224: est; blastn; identity 90; region 100..151
  id N78069
  misc_feature 233..381: est; blastn; identity 95; region 183..331
  id AA022144
  misc_feature 117..234: est; blastn; identity 90; region 69..186
  id AA022144
  misc_feature 89..129: est; blastn; identity 95; region 42..82
  id AA022144
  misc_feature 242..369: est; blastn; identity 93; region 170..297
  id AA043627
  misc_feature 89..129: est; blastn; identity 95; region 21..61
  id AA043627
  misc_feature 117..233: est; blastn; identity 93; region 194..310
  id W68800
  misc_feature 251..304: est; blastn; identity 94; region 329..382
  id W68800
  misc_feature 89..129: est; blastn; identity 95; region 167..207
  id W68800
  misc_feature 117..224: est; blastn; identity 94; region 70..177
  id H91637
  misc_feature 251..337: est; blastn; identity 94; region 202..288
  id H91637
  misc_feature 89..129: est; blastn; identity 95; region 43..83
  id H91637
  unsure 32,44: est
  position 32, 44 of amino acid sequence
  unsure 28: Xaa = Ile,Leu
  position 28 of amino acid sequence
  unsure 41: Xaa = Leu,Met,Val; position 41 of amino acid sequence; Xaa =  * ,Tyr
aaactctcaacccacttctccagccagcgccccagccctcccgccgcccgctcgcaggtcccgaggagcgcagactgtgkccctggcaaatgggaacagchgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcdtgagtgcagtcmtaggaggatttttctacatccgcgactasaccctcmtcgtcacctcgggagcwgccatctggacaggggctgtggctgtg

SEQ ID NO: 1700 - DNA, 237 bp, Homo Sapiens
  brain
  sig_peptide 175..216: Von Heijne matrix
  score 5.60
  misc_feature 201..234: seq SLLSFLFARVNLG/SP; blastn; identity 100; region 1..34; id R74380; est
actatcctatcttctttaaggaaaacttaccaagtatgatttggtccaaggatttcaggtgggctctcagtgctgctcccaatatattagaggtctccttcctttactatttcctaaccagatgtaaaattagcttttccccccttctacatcacctaacccgtttctcattggatgtccttgctttcgtttttatttgccagagtaaatctaggatctcccttgtctgccaacggg

SEQ ID NO: 1701 - DNA, 375 bp, Homo Sapiens
  Cerebellum
  sig_peptide 136..264: Von Heijne matrix
  score 4.20
  misc_feature 90..376: seq WWCCPARLTLTSG/WP; blastn; identity 97; region 5..291
  id R59435
  misc_feature 206..376: est; blastn; identity 100; region 1..171
  id R19220
  misc_feature 199..371: est; blastn; identity 95; region 1..173
  id HSC32F041
  misc_feature 283..371: est; blastn; identity 97; region 1..89; id HSC2VA021; est
actctttttgaaggtctcctttgccagcgcacacggctccctgggctggaatgtctgttcattcatccctgcagttgtttgcggatgtcccggggghwaacgtgagtyagttaatgaagtccaaagccaagcccaatggcaagaagcccgctgcggaggagaggaaggcctacctggagcctgagcacaccaaggccaggatcaccgacttccagttcaaggagctggtggtgctgccccgcgagattgaccttaacgagtggctggccagcaacaccacgacgtttttccaccacatcaacctgcagtatagcaccatctcggagttctgcacaggagagacgtgtcagacgatggccgtgtgcaacacacagt

SEQ ID NO: 1702 - DNA, 268 bp, Homo Sapiens
  Substantia nigra
  sig_peptide 158..214: Von Heijne matrix
  score 3.70
  misc_feature 40..264: seq TLLLACHLQLEVG/VV; blastn; identity 100; region 1..225
  id T05872
  misc_feature 64..264: est; blastn; identity 98; region 2..202
  id T34681
  misc_feature 85..264: est; blastn; identity 100; region 1..180
  id T05903
  misc_feature 157..228: est; blastn; identity 100; region 25..96
  id N56217
  misc_feature 223..264: est; blastn; identity 100; region 92..133; id N56217; est
aatcattttgaagacagaggagcagctgttaaggctatggatgaaatgaatggcaaagaaatagaaggggaagaaattgaaatagtcttagccaagccaccagacaagaaaaggaaagagcgccaagctgctagacaggcctccagaagcactgcgtatgaagattattactaccaccctcctcctcgcatgccacctccaattagaggtcggggtcgtggtggggggagaggtggatatggctaccctccagattactacggcatcg

SEQ ID NO: 1703 - DNA, 195 bp, Homo Sapiens
  Substantia nigra
  sig_peptide 76..186: Von Heijne matrix
  score 3.70
  misc_feature 118..191: seq FLGVLALLGYLAV/RP; blastn; identity 98; region 112..185
  id R60698
  misc_feature 122..191: est; blastn; identity 100; region 1..70
  id H17558
  misc_feature 113..191: est; blastn; identity 92; region 229..307
  id N26943
  misc_feature 118..191: est; blastn; identity 94; region 145..218; id W24886; est
aataagttctcgcgagacgcakaaggcaccggctcgaactggggcgggccactgccaggaaagcaacgcccctgaatgcttatgccggtggttggtagaggaaatggaattccccagactgtttcagaatggcttcggttattgcctttccttggtgtactcgcacttcttggctaccttgcagttcgtcccggg

SEQ ID NO: 1704 - DNA, 386 bp, Homo Sapiens
  Cerebellum
  sig_peptide 150..296: Von Heijne matrix
  score 3.60
  misc_feature 114..343: seq PPFFLCLQCFTRG/FE; blastn; identity 99; region 76..305
  id T91418
  misc_feature 41..118: est; blastn; identity 96; region 2..79; id T91418; est
aaggcgcgcgcgaccggcggctctttggcgcggattagggggtctcggcgagggagtcatcaagctttggtgtatgtgttggccggttctgaagtcttgaagaagctctgctgaggaagaccaaagcagcactcgttgccaattagggaatggaccgtttgggttcctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatggcaggatgtagccaatcaaatgtgcaccaagaccaaggaggtcag

SEQ ID NO: 1705 - DNA, 389 bp, Homo Sapiens
  Cerebellum
  sig_peptide 57..317: Von Heijne matrix
  score 3.60
  misc_feature 101..384: seq GLLLLYMVYLTLV/EP; blastn; identity 98; region 1..284
  id R35114
  misc_feature 90..365: est; blastn; identity 91; region 196..471
  id W65227
  misc_feature 45..96: est; blastn; identity 90; region 152..203
  id W65227
  misc_feature 90..349: est; blastn; identity 93; region 173..432
  id AA116536
  misc_feature 90..384: est; blastn; identity 90; region 3..297
  id AA065524
  misc_feature 154..384: est; blastn; identity 98; region 1..231
  id R52412
  unsure 5: est
  position 5 of amino acid sequence
  unsure 20: Xaa = Glu,Lys,Gln; position 20 of amino acid sequence; Xaa = Asp,Asn
aagaaagccgacggggtgctgtggtcaggaggcgcgtgggcggcagaatttcgaggatgtcagatgtaaatgtatctgccctccctataaagaaaaattctgggcatatttataataagaacatatctcagaaagattgtgattgccttcatgtcgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgvagaggcgcctctttggacatgcacagttgatacagagtgatgatratattgggggattg

SEQ ID NO: 1706 - DNA, 228 bp, Homo Sapiens
  Cerebellum
  sig_peptide 85..222: Von Heijne matrix
  score 3.50
  misc_feature 45..150: seq ALSLSLSMAPPNP/GP; blastn; identity 98; region 25..130
  id H30752
  misc_feature 150..222: est; blastn; identity 95; region 129..201
  id H30752
  misc_feature 93..222: est; blastn; identity 91; region 76..205
  id AA072341
  misc_feature 73..156: est; blastn; identity 95; region 1..84
  id T31153
  misc_feature 150..222: est; blastn; identity 95; region 77..149
  id T31153
  misc_feature 79..150: est; blastn; identity 98; region 87..158
  id W74452
  misc_feature 152..222: est; blastn; identity 100; region 158..228
  id W74452
  misc_feature 79..150: est; blastn; identity 98; region 81..152
  id H26405
  misc_feature 150..222: est; blastn; identity 97; region 151..223
  id H26405
  unsure -44: est; position -44 of amino acid sequence; Xaa = Asp,Glu
acacctccccgccttgttgtccaacttctcccggagcagccggagagcaggcgtcgggacgcagcaaagagaggagaggccaccatggcggastgcaggaggtgcagatcacagaggagaagccactgttgccaggacagacgcctgaggcggccaagactcactctgtggagacaccatacggctctgtcactttcactgtctatggcacccccaaacccaggcccg

SEQ ID NO: 1707 - DNA, 376 bp, Homo Sapiens
  Substantia nigra
  sig_peptide 89..196: Von Heijne matrix
  score 3.50
  misc_feature 246..375: seq LALTALSVXRKXS/XX; blastn; identity 96; region 9..138
  id N56074
  est
  misc_feature 211: n=a, g, c or t
  unsure -5: position -5 of amino acid sequence
  unsure -2: Xaa = Ala,Gly
  position -2 of amino acid sequence
  unsure 1: Xaa = Phe,Leu
  position 1 of amino acid sequence
  unsure 2: Xaa = Asn,Ser
  position 2 of amino acid sequence
  unsure 3: Xaa = Gly,Val
  position 3 of amino acid sequence
  unsure 4: Xaa = Asp,Glu,Lys,Asn
  position 4 of amino acid sequence
  unsure 5: Xaa = Leu,Arg,Trp
  position 5 of amino acid sequence
  unsure 6: Xaa =  * ,Cys,Phe,Leu,Trp
  position 6 of amino acid sequence
  unsure 12: Xaa = Glu,Lys; position 12 of amino acid sequence; Xaa =  * ,Leu,Ser
actgtctggcagcctgcaagtctccattcagaagcggctccgtgctgcccagcgatggcgccctggcggcgcggaagcccgcggccaaatgacacgacttgggggcaaaggaggacaacagttcccaccaggacaaaaaataatatccaaagatattttggcactaacggcgctatctgtagsaagraagttkagcartgkgramykgtknragacttccaaggagacttbagacaaccaagacagtgtaaaggaaaacagagaaaaagacttgttagacattattaagggcacgaaagttgaattgagcacagtaaatgtacaaacaacaaagccacccaacagaagttcacttaaaagctacaactggcgggcg

SEQ ID NO: 1708 - DNA, 265 bp, Homo Sapiens
  Substantia nigra
  sig_peptide 194..253: Von Heijne matrix
  score 12.40
  misc_feature 123..265: seq ALLLGALLGTAWA/RR; blastn; identity 97; region 187..329
  id N57089
  misc_feature 47..127: est; blastn; identity 97; region 110..190
  id N57089
  misc_feature 3..218: est; blastn; identity 97; region 2..217
  id AA136163
  misc_feature 154..266: est; blastn; identity 98; region 52..164
  id R22491
  misc_feature 104..160: est; blastn; identity 94; region 3..59
  id R22491
  misc_feature 47..150: est; blastn; identity 99; region 1..104; id R29291; est
aaggcggtcgccgggacaccccgtgtgtggcaggcggcgaasgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccgg

SEQ ID NO: 1709 - DNA, 222 bp, Homo Sapiens
  brain
  sig_peptide 88..135: Von Heijne matrix
  score 11.40
  misc_feature 134..220: seq LLCLLLLFGGGDP/RR; blastn; identity 91; region 14..100; id AA001733; est
aaaggtgcgcgtgctcgctggttctaacccttctgttgggcgtttctgcggagaggcgggaggcgctgagagtctgtgcggaggtccatgcacagactgctttgcctgttgttgctcttcggaggcggcgatccccgaaggcgagctgaaatacggctgcaggctacaatttgcagccgaccattaaggaagacgacgagcgggagaggtggcccaccctgg

SEQ ID NO: 1710 - DNA, 472 bp, Homo Sapiens
  Substantia nigra
  sig_peptide 89..154: Von Heijne matrix
  score 11.10
  misc_feature 245..466: seq QLLALFFLPFCLC/QD; blastn; identity 92; region 74..295
  id R61190
  misc_feature 181..258: est; blastn; identity 94; region 11..88
  id R61190
  unsure 103: est; position 103 of amino acid sequence; Xaa = Ala,Glu
agctccagtcctggcatctgcccgaggagaccacgctcctggagctctgctgtcttctcagggagactctgaggctctgttgagaatcatgctttggaggcagctcatctattggcaactgctggctttgtttttcctccctttttgcctgtgtcaagatgaatacatggagtctccacaaaccggaggactacccccagactgcagtaagtgttgtcatggagactacagctttcgaggctaccaaggcccccctgggccaccgggccctcctggcattccaggaaaccatggaaacaatggcaacaatggagccactggtcatgaaggagccaaaggtgagaagggcgacaaaggtgacctggggcctcgaggggagcgggggcagcatggccccaaaggagagaagggctacccggggattccaccagaacttcagattgcattcatggcttctctggmacccacttca

SEQ ID NO: 1711 - DNA, 191 bp, Homo Sapiens
  Substantia nigra
  sig_peptide 81..131: Von Heijne matrix
  score 9.20
  misc_feature 37..193: seq LLLLVAASAMVRS/XA; blastn; identity 96; region 1..157
  id T30099
  misc_feature 53..193: est; blastn; identity 96; region 1..141
  id T35974
  misc_feature 58..193: est; blastn; identity 96; region 1..136
  id T35248
  misc_feature 58..193: est; blastn; identity 96; region 1..136
  id T32601
  misc_feature 59..193: est; blastn; identity 96; region 1..135
  id T31945
  unsure 1: est; position 1 of amino acid sequence; Xaa = Asp,Glu
aagtggggagcagctcgctcctgggctttgggctggctgcagtctgtctgagggcggccgaagtggctggctcattkaagatgaggcttctactgcttctcctagtggcggcgtctgcgatggtccggagcgakgcctcggccaatctgggcggcgtgcccagcaagagattaaagatgcagtacaccacg

SEQ ID NO: 1712 - DNA, 561 bp, Homo Sapiens
  Substantia nigra
  sig_peptide 166..240: Von Heijne matrix
  score 9.00
  misc_feature 136..210: seq ALLVLLGVAASLC/VR; blastn; identity 92; region 177..251
  id H23535
  est
  misc_feature 500..502: n=a, g, c or t
  unsure -21: position -21 of amino acid sequence
  unsure 59: Xaa = Ala,Thr
  position 59 of amino acid sequence
  unsure 64: Xaa = His,Tyr
  position 64 of amino acid sequence
  unsure 70: Xaa = Ala,Asp
  position 70 of amino acid sequence
  unsure 71: Xaa = Gly,Val
  position 71 of amino acid sequence
  unsure 73: Xaa = Pro,Thr
  position 73 of amino acid sequence
  unsure 87: Xaa = Ile,Leu
  position 87 of amino acid sequence
  unsure 88: Xaa = Ile,Lys,Met,Asn,Arg,Ser,Thr; position 88 of amino acid sequence; Xaa = Ala,Cys,Asp,Gly,His,Asn,Pro,Arg,Ser,Thr,Tyr
aggatgtacggatgattcagtggctggcaggaagcccgccctgcccgcccgccagtgtcagtggtgttggcatcagcttgggcaggtgtgcgggctcaggatggggcggccgtggtgaggaaccctggactctcagcatcacaagaggcaacaccaggagccaacatgagctcggggrctgaactgctgtggcccggagcagcgctgctggtgctgttgggggtggcagccagtctgtgtgtgcgctgctcacgcccaggtgcaaagaggtcagagaaaatctaccagcagagaagtctgcgtgaggaccaacagagctttacggggtcccggacctactccttggtcgggcaggcatggccaggacccctggcggacatggcacccacaaggaaggacaagctgttgcaattcyaccccagcctggaggmtccaagcatcttccaggkrmcagaamttcagccagtctgtgtgtgcgctgctcacgcccaggtgcaaannnvtcagagaaaatctaccagcagagaagtctgcgtgaggaccaacagagctttacggggc

SEQ ID NO: 1713 - DNA, 375 bp, Homo Sapiens
  brain
  sig_peptide 1..234: Von Heijne matrix
  score 8.80
  misc_feature 128..305: seq SCLGLTLMPFASS/FP; blastn; identity 100; region 106..283
  id H14437
  misc_feature 24..116: est; blastn; identity 100; region 2..94
  id H14437
  misc_feature 317..376: est; blastn; identity 100; region 36..95; id HSA86D041; est
atgactaaggagattttttttttcacagttgagttagtttgtgaaaataaagaactctgtagctcaccaaggtggagaaacgcaattcagaaaagtaatttctccaaggtcacttctttttttatgtcttgccatcactttaaaggactagccccactcccccatgtgtatacacaaggaaattgcagaccaattagttgtcttggcctgactctaatgccttttgcaagtagctttccagaagtaaaagtcccagtgatgtattcccatagaaatatttttcagttgtttatgtcgtttactacaaaaaaaaagattcagagtggatggagtacaactctgagtatttttctagtccggaattttttattaata

SEQ ID NO: 1714 - DNA, 339 bp, Homo Sapiens
  Substantia nigra
  sig_peptide 253..315: Von Heijne matrix
  score 7.50
  misc_feature 209..332: seq YFRALCLPRGAWG/FP; blastn; identity 99; region 39..162
  id N42351
  misc_feature 209..324: est; blastn; identity 95; region 39..154
  id N42357
  misc_feature 209..284: est; blastn; identity 97; region 25..100; id T57420; est
aaggtgagctgaggtacctggctttagtgaagaccctgtgggggcttcctggctgcggcttcgacrwgcctgastccasacgcccctaaggtttgatgaaaacctgctggaggtttgggacctaaccgcatcaaagtcgcctttagcggtgcctggacccagttcgcacgggaggaagtaggaggcagaatcccctttgggccacagaaagctcacctgttactcggcctcccagaaagatggataggagaaatgactacggatatagggtgcctctatttcagggccctctgcctcccccggggagcctggggcttcccttccctccagattaagggg

SEQ ID NO: 1715 - DNA, 112 bp, Homo Sapiens
  brain
  sig_peptide 38..103: Von Heijne matrix
  score 7.40
  misc_feature 10..109: seq LTCLFLFLNLRWS/RH; blastn; identity 96; region 1..100
  id W30713
  misc_feature 24..109: est; blastn; identity 100; region 1..86
  id HUM402E06B
  misc_feature 44..109: est; blastn; identity 98; region 30..95; id H50196; est
agtgtctgcacttcggctgctctcgggttagcaccctatggtgccttctcttgtgatccctgacctaacctgtctcttccttttcctcaacctcaggtggagccgccacgta

SEQ ID NO: 1716 - DNA, 191 bp, Homo Sapiens
  Substantia nigra
  sig_peptide 24..68: Von Heijne matrix
  score 7.00
  misc_feature 89..189: seq LRLLKLAATSASA/RV; blastn; identity 96; region 71..171
  id R11825
  misc_feature 17..84: est; blastn; identity 91; region 1..68
  id R11825
  misc_feature 98..189: est; blastn; identity 98; region 83..174
  id H08475
  misc_feature 13..84: est; blastn; identity 94; region 1..72
  id H08475
  misc_feature 30..84: est; blastn; identity 92; region 49..103
  id AA113990
  misc_feature 150..189: est; blastn; identity 95; region 163..202
  id AA113990
  misc_feature 89..141: est; blastn; identity 92; region 67..119
  id C14102
  misc_feature 46..89: est; blastn; identity 90; region 25..68
  id C14102
  misc_feature 160..189: est; blastn; identity 93; region 141..170
  id C14102
  unsure 4: est
  position 4 of amino acid sequence
  unsure 6: Xaa = Ala,Glu,Lys,Thr; position 6 of amino acid sequence; Xaa = Asp,Glu,Gly
gatcctgagctgaccgggtagccatggccttgcggctcctgaagctggcagcgacgtccgcgtccgcccgggtcgtgrmggcggrmgcccagcgcgtgagaggaattcatagcagtgtgcagtgcaagctgcgctatggaatgtggcatttcctacttggggataaagcaagcaaaagactgacagtacag

SEQ ID NO: 1717 - DNA, 160 bp, Homo Sapiens
  Substantia nigra
  sig_peptide 29..88: Von Heijne matrix
  score 6.90
  misc_feature 24..161: seq VLLFLYSVLLTKG/IE; blastn; identity 99; region 1..138
  id AA046377
  misc_feature 75..161: est; blastn; identity 98; region 1..87
  id AA112337
  misc_feature 33..62: est; blastn; identity 96; region 333..362
  id R72972
  unsure 24: est; position 24 of amino acid sequence; Xaa = Asn,Ser
aaaagatgctgtcttggaccagtattcaatgtggggaaataaatttggagtattgctttttctgtattctgtattactgacaaagggcattgaaaacataaaaaacgaaattgaagatgcaagtgaacccttgatagatcctgtatatggacatggcarc

SEQ ID NO: 1718 - DNA, 410 bp, Homo Sapiens
  Substantia nigra
  sig_peptide 279..359: Von Heijne matrix
  score 6.80
  misc_feature complement(2..353): seq VFVCSSVLGQSWG/GF; blastn; identity 98; region 1..352
  id N43180
  misc_feature complement(2..332): est; blastn; identity 100; region 1..331
  id W56791
  misc_feature 70..396: est; blastn; identity 97; region 1..327
  id T32797
  misc_feature complement(123..396): est; blastn; identity 96; region 62..335
  id T08229
  misc_feature complement(109..396): est; blastn; identity 97; region 62..349; id HSC27A061; est
atgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgacactctttaatgga

SEQ ID NO: 1719 - DNA, 188 bp, Homo Sapiens
  brain
  sig_peptide 120..182: Von Heijne matrix
  score 6.40
  misc_feature 3..186: seq TFCLIFGLGAVWG/LV; blastn; identity 98; region 3..186
  id T31677
  misc_feature 3..186: est; blastn; identity 97; region 3..186
  id HUM76142
  misc_feature 39..186: est; blastn; identity 96; region 1..148; id M85529; est
aaaaatccgaggcagcagcaggagagacaaacgttattttcccgcttgattccaagaacctcttcgatatttatttttatttttaaagagggagacgatggactgagctgatccgcaccatggagtctcgggtcttactgagaacattctgtttgatcttcggtctcggagcagtttgggggctggtg

SEQ ID NO: 1720 - DNA, 218 bp, Homo Sapiens
  brain
  sig_peptide 33..143: Von Heijne matrix
  score 6.40
  misc_feature complement(37..103): seq ILIFLGFFLGLFH/QF; blastn; identity 97; region 2..68
  id HSC07B041
  misc_feature complement(2..38): est; blastn; identity 97; region 68..104
  id HSC07B041
  misc_feature complement(1..38): est; blastn; identity 97; region 60..97
  id W23273
  misc_feature complement(2..38): est; blastn; identity 97; region 60..96
  id W22817
  misc_feature complement(2..37): est; blastn; identity 91; region 54..89; id W23007; est
acggcccggcaggaacaactcattccgcttatatgcttgttcttaaaaagcactcggtaaacattgcggcccagacgtgttttaaattcaattttattttcaggatcctcatctttcttggtttctttctggggcttttccatcagttcctcttcctctttctctttgctggcaatctcagctcgtaccttttgaagcagagcaaaatccaagccagg

SEQ ID NO: 1721 - DNA, 314 bp, Homo Sapiens
  Substantia nigra
  sig_peptide 165..260: Von Heijne matrix
  score 6.30
  misc_feature complement(110..315): seq TVVLCVGCSTVLC/QP; blastn; identity 96; region 186..391
  id AA046808
  misc_feature complement(8..105): est; blastn; identity 90; region 394..491
  id AA046808
  misc_feature complement(110..315): est; blastn; identity 96; region 204..409
  id AA156232
  misc_feature complement(6..75): est; blastn; identity 92; region 441..510
  id AA156232
  misc_feature 110..265: est; blastn; identity 96; region 101..256
  id AA147488
  misc_feature 264..315: est; blastn; identity 94; region 256..307
  id AA147488
  misc_feature 110..282: est; blastn; identity 96; region 108..280
  id AA157472
  misc_feature 2..75: est; blastn; identity 98; region 3..76
  id AA157472
  misc_feature 110..315: est; blastn; identity 96; region 100..305
  id AA046825
  misc_feature 8..75: est; blastn; identity 98; region 1..68
  id AA046825
  est
  misc_feature 134: n=a, g, c or t
agcttgcagcttgctagctgtgtgggctgggaggtctggtagggctgagcttgcaagaggrtcaacatgcctttggctagagayktamtacatrcgtmcytggrrwgwggyabaagavmamacataaaaagaancgcctagtacaaagtccaaattcttactttatggatgtaaaatgtccaggttgctacaagatcaccacggttttcagccatgctcagacagtggttctttgtgtaggttgttcaacagtgttgtgccagcctacaggaggaaaggccagactcacagaagggtgttcatttaggmgaaag

SEQ ID NO: 1722 - DNA, 228 bp, Homo Sapiens
  brain
  sig_peptide 163..210: Von Heijne matrix
  score 6.20
  misc_feature 120..227: seq ILSVLHALPAGIA/WS; blastn; identity 96; region 183..290
  id T34489
  misc_feature 80..119: est; blastn; identity 95; region 144..183
  id T34489
  misc_feature 120..227: est; blastn; identity 97; region 141..248
  id HUM416B01B
  misc_feature 80..119: est; blastn; identity 95; region 102..141
  id HUM416B01B
  misc_feature 120..220: est; blastn; identity 97; region 140..240
  id HUM425D11B
  misc_feature 80..119: est; blastn; identity 95; region 101..140
  id HUM425D11B
  misc_feature 120..227: est; blastn; identity 97; region 28..135
  id AA147546
  misc_feature 120..154: est; blastn; identity 91; region 26..60; id AA103632; est
acattatcaagagagagagaaggttaggatgaaagagatgagcagaggcaaatcttaagtgttgacaccatgattgaaaaggttatttggaaatagcggtgcttgcagcgcytgcggamcrgtcgattcctgcgagtgaactcgtcatgagggcgcaaggcaatgtgtatcatcttaagtgttttacatgctctacctgccggaatcgcctggtcccgggagaaaggg

SEQ ID NO: 1723 - DNA, 255 bp, Homo Sapiens
  Surrenals
  sig_peptide 46..225: Von Heijne matrix
  score 5.90
  misc_feature 58..255: seq TWLLLGALEPASE/RP; blastn; identity 98; region 176..373
  id AA082793
  misc_feature complement(97..255): est; blastn; identity 98; region 352..510
  id AA129762
  misc_feature complement(66..97): est; blastn; identity 100; region 511..542
  id AA129762
  misc_feature 89..214: est; blastn; identity 98; region 11..136
  id H56715
  misc_feature 207..255: est; blastn; identity 93; region 128..176
  id H56715
  misc_feature complement(191..255): est; blastn; identity 98; region 355..419
  id AA101128
  misc_feature complement(151..189): est; blastn; identity 97; region 423..461
  id AA101128
  misc_feature complement(119..151): est; blastn; identity 90; region 462..494; id AA101128; est
agcagctgtttcggtaactgctttgcctcccggctcccgcagwggatgctggtggtggaggcttcttcctcagtgcggctggcaagttcggaggtgacttcctggtctatcctggtgaccccctccgcttccacgcccattatatcgctcagtgctgggcccctgaggacaccatcccactccaagacctggttgctgctgggcgccttggaaccagcgtcagaaagaccctgctcctctgttctccgcagccgg

SEQ ID NO: 1724 - DNA, 285 bp, Homo Sapiens
  brain
  sig_peptide 181..261: Von Heijne matrix
  score 5.70
  misc_feature 22..201: seq LSLQLIAFPTVSC/EI; blastn; identity 95; region 5..184
  id W07565
  misc_feature 200..282: est; blastn; identity 100; region 184..266
  id W07565
  misc_feature 132..209: est; blastn; identity 98; region 102..179
  id R58430
  misc_feature 208..282: est; blastn; identity 96; region 177..251
  id R58430
  misc_feature 29..80: est; blastn; identity 96; region 1..52
  id R58430
  misc_feature 82..132: est; blastn; identity 96; region 53..103
  id R58430
  misc_feature 7..118: est; blastn; identity 98; region 1..112
  id W19152
  misc_feature 175..282: est; blastn; identity 96; region 109..216
  id W19152
  misc_feature 175..282: est; blastn; identity 99; region 95..202
  id AA095767
  misc_feature 69..118: est; blastn; identity 100; region 49..98
  id AA095767
  misc_feature 20..74: est; blastn; identity 92; region 1..55
  id AA095767
  misc_feature 175..282: est; blastn; identity 99; region 99..206
  id T86637
  misc_feature 22..118: est; blastn; identity 92; region 6..102; id T86637; est
cgcctcctccgctttgggagcmccgggctamtctttcacagcccctgttgccctgtgatctgtaggtccttggggacgcacagttaagatgacaggacatcctggaagctgggaaatggctgaatgctatcccagtgaatatacgtgccctgtttgttgaatctactcatccttaaagatatgtattcatttcctaccaccgtagtggaagagatactatccctatctttacaactgatagcatttccaacagtaagctgtgagattctgcttgaaatcaccagg

SEQ ID NO: 1725 - DNA, 174 bp, Homo Sapiens
  brain
  sig_peptide 115..162: Von Heijne matrix
  score 5.60
  misc_feature 75..168: seq LLPLRSLLALVRE/SR; blastn; identity 91; region 200..293; id N57841; est
aaagctttaacgagcttataaatcacttggtaaatttgaccccactttatgtaatgtgattctgcaggtttgaaaaaggtccataaataggtgttttaaacaagtttcctgtcaatgctgatgttgctcccccttcgctcattattagcattagttagagaaagcagggcacgg

SEQ ID NO: 1726 - DNA, 407 bp, Homo Sapiens
  Cerebellum
  sig_peptide 99..173: Von Heijne matrix
  score 5.50
  misc_feature 37..217: seq AQLFACLLRLGTQ/QV; blastn; identity 97; region 1..181
  id AA057016
  misc_feature 216..378: est; blastn; identity 96; region 179..341
  id AA057016
  misc_feature 34..217: est; blastn; identity 98; region 1..184
  id AA133917
  misc_feature 216..327: est; blastn; identity 94; region 182..293
  id AA133917
  misc_feature 325..366: est; blastn; identity 90; region 290..331
  id AA133917
  misc_feature 216..342: est; blastn; identity 99; region 119..245
  id R13065
  misc_feature 114..217: est; blastn; identity 97; region 18..121
  id R13065
  unsure 69: est; position 69 of amino acid sequence; Xaa = Ile,Asn,Ser
aagtccaggccttgagacccagaagggagcgaaggtttttgctgcgccaacgcagtgagccgaagctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgcaadcaattgtcctcatctggtcgtcccacgg

SEQ ID NO: 1727 - DNA, 184 bp, Homo Sapiens
  Substantia nigra
  sig_peptide 110..169: Von Heijne matrix
  score 5.40
  misc_feature 18..180: seq AFVIACVLSLIST/IY; blastn; identity 93; region 18..180
  id AA110680
  misc_feature 40..180: est; blastn; identity 95; region 64..204
  id W30470
  misc_feature 91..180: est; blastn; identity 94; region 46..135
  id HSC0CC021
  misc_feature 91..180: est; blastn; identity 100; region 23..112
  id HUMHG5097
  misc_feature 80..180: est; blastn; identity 94; region 16..116; id AA089700; est
agagctagagggtgaagctggcggagcaggaggatgggcgtatgcaggtgatagactagagaacaagacctctgtctccgtagcatcctggagcagtctgaatgccagaatggataaccgttttgctacagcatttgtaattgcttgtgtgcttagcctcatttccaccatctacatggcccgg

SEQ ID NO: 1728 - DNA, 371 bp, Homo Sapiens
  Substantia nigra
  sig_peptide 12..137: Von Heijne matrix
  score 5.40
  misc_feature complement(1..223): seq WTLLLTSLDGHLL/EP; blastn; identity 99; region 277..499
  id AA059399
  misc_feature complement(236..330): est; blastn; identity 100; region 170..264
  id AA059399
  misc_feature complement(332..371): est; blastn; identity 95; region 130..169
  id AA059399
  misc_feature complement(6..143): est; blastn; identity 98; region 357..494
  id N35134
  misc_feature complement(236..371): est; blastn; identity 97; region 128..263
  id N35134
  misc_feature complement(141..223): est; blastn; identity 97; region 276..358
  id N35134
  misc_feature complement(44..223): est; blastn; identity 98; region 223..402
  id H49423
  misc_feature complement(236..371): est; blastn; identity 98; region 75..210
  id H49423
  misc_feature 14..190: est; blastn; identity 99; region 1..177
  id H43799
  misc_feature 236..342: est; blastn; identity 98; region 224..330
  id H43799
  misc_feature 338..369: est; blastn; identity 93; region 327..358
  id H43799
  misc_feature complement(85..223): est; blastn; identity 99; region 223..361
  id H27862
  misc_feature complement(266..346): est; blastn; identity 92; region 101..181
  id H27862
  misc_feature complement(236..269): est; blastn; identity 97; region 177..210
  id H27862
  unsure 68: est; position 68 of amino acid sequence; Xaa = Ala,Val
aggatgacctgatgcctgagtactgtggcaatgaggtgactccaaccgaggctgcccaagcgccagaggtgacctatgaggcagaagagggctccttgtggacgttgctactcactagcttggatgggcacctgctggagccagatgctgagtacctccactggctgctaaccaacatcccgggtaaccgggtggctgaaggacaggtgacgtgtccctacctcccccccttccctgcccgaggctccggcatccaccgtcttgccttcctgctcttcaagcaggaccagccgattgacttctctgaggacgcacgcccctcaccctgctatcagctggyscagcggaccttccgcacttttgatttctac

SEQ ID NO: 1729 - DNA, 118 bp, Homo Sapiens
  Surrenals
  sig_peptide 23..67: Von Heijne matrix
  score 5.40
  misc_feature 51..114: seq RVLCAPAAGAVRA/LR; blastn; identity 98; region 112..175
  id AA029014
  misc_feature 20..55: est; blastn; identity 100; region 1..36
  id AA029014
  misc_feature 5..55: est; blastn; identity 98; region 1..51
  id AA029165
  misc_feature 70..114: est; blastn; identity 100; region 66..110
  id AA029165
  misc_feature 29..58: est; blastn; identity 90; region 8..37; id W79853; est
aagtcgaggagtcaaggcagcaatgaatcgtgtcttgtgtgccccggcggccggggccgtccgggcgctgaggctcataggctgggcttcccgaagccttcatccgttgcccggaaag

SEQ ID NO: 1730 - DNA, 183 bp, Homo Sapiens
  Substantia nigra
  sig_peptide 49..117: Von Heijne matrix
  score 5.30
  misc_feature 123..181: seq MLALLLTAALIFF/AI; blastn; identity 96; region 133..191
  id W02973
  misc_feature 4..55: est; blastn; identity 100; region 13..64
  id W02973
  misc_feature 56..102: est; blastn; identity 100; region 66..112
  id W02973
  misc_feature 55..181: est; blastn; identity 100; region 38..164
  id T97581
  misc_feature 19..56: est; blastn; identity 100; region 1..38
  id T97581
  misc_feature 21..181: est; blastn; identity 91; region 58..218
  id W70849
  misc_feature 21..181: est; blastn; identity 91; region 47..207
  id AA049525
  misc_feature 22..181: est; blastn; identity 91; region 4..163; id H32732; est
actttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagttg

SEQ ID NO: 1731 - DNA, 169 bp, Homo Sapiens
  brain
  sig_peptide 89..139: Von Heijne matrix
  score 5.30
  misc_feature 107..143: seq XEXLLAFHHDCEA/SP; blastn; identity 94; region 125..161
  id N86955
  unsure -11: est
  position -11 of amino acid sequence
  unsure -13: Xaa = Phe,Leu
  position -13 of amino acid sequence
  unsure -14: Xaa = Ser,Thr
  position -14 of amino acid sequence
  unsure -15: Xaa = Glu,Lys,Met,Val
  position -15 of amino acid sequence
  unsure -16: Xaa = Asp,Gly,Asn,Ser; position -16 of amino acid sequence; Xaa = Gln,Arg
aataggtaatgagtcttatgagatctgttggttttaaaaacaggagtttctctgcgcaasctctgtctttttttgcctgctggcatccatgcrarrcrwgastgagytcctccttgccttccaccatgattgtgaggcttccccagccacgtggaacttaagtccaagg

SEQ ID NO: 1732 - DNA, 240 bp, Homo Sapiens
  brain
  sig_peptide 13..120: Von Heijne matrix
  score 5.20
  misc_feature complement(15..236): seq PLRLLNLLILIEG/SV; blastn; identity 99; region 314..535; id AA194996; est
ttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggatcag

SEQ ID NO: 1733 - DNA, 207 bp, Homo Sapiens
  brain
  sig_peptide 67..135: Von Heijne matrix
  score 5.20
  misc_feature 31..207: seq IGVGLYLLASAAA/FY; blastn; identity 98; region 1..177
  id W44975
  misc_feature 45..207: est; blastn; identity 98; region 1..163
  id N43016
  misc_feature 47..207: est; blastn; identity 98; region 1..161
  id R10507
  misc_feature 49..207: est; blastn; identity 98; region 1..159
  id H70117
  misc_feature 48..207: est; blastn; identity 98; region 1..160
  id H61870
  unsure 23: est; position 23 of amino acid sequence; Xaa = His,Leu,Pro
agcggcggcatccgggacggcgggcgggctggccaccacgggacaggaaggcacagagcatggagaatgatgaacttccgtcagcggatgggatggattggagtgggattgtatctgttagccagtgcagcagcattttactatgtttttgaaatcagtgagacttacaacaggctggccttggaacacattcaacagcacchtggg

SEQ ID NO: 1734 - DNA, 487 bp, Homo Sapiens
  Substantia nigra
  sig_peptide 98..451: Von Heijne matrix
  score 5.10
  misc_feature 71..252: seq AFXVVCWLGPCEA/MH; blastn; identity 97; region 149..330
  id R18686
  misc_feature 252..304: est; blastn; identity 100; region 331..383
  id R18686
  misc_feature 23..73: est; blastn; identity 100; region 1..51
  id R18686
  misc_feature 186..375: est; blastn; identity 99; region 1..190
  id R54039
  misc_feature 376..489: est; blastn; identity 94; region 190..303
  id R54039
  misc_feature 94..303: est; blastn; identity 98; region 70..279
  id HSC2LA121
  misc_feature 26..97: est; blastn; identity 93; region 1..72
  id HSC2LA121
  misc_feature 236..375: est; blastn; identity 99; region 1..140
  id N91698
  misc_feature 376..458: est; blastn; identity 95; region 140..222
  id N91698
  misc_feature 458..489: est; blastn; identity 96; region 223..254
  id N91698
  unsure -110,-18: est
  position -110, -18 of amino acid sequence
  unsure -11: Xaa = His,Gln; position -11 of amino acid sequence; Xaa = Glu,Lys,Gln
aagcgcccgcvgsscgcgtccccggcccaaccatggcgtcctccgcggccggctgcgtggtgatcgttggcagtggagtcattgggcgarstgggccatgctgtttgccagtggaggcttccakgtgaaactctatgacattgagcaacagcagataaggaacgccctggaaaacatcagaaaggagatgaagttgctggagcaggcaggttctctgaaaggctccctgagtgtggaagagcagctgtcactcatcagtggttgtcccaatatccaagaagcagtagagggtgccatgcacattcaggaatgtgttccagaagatctagaactgaagaagaagatttttgctcagttagattccatcattgatgaatcgagtgatcttaagcgtttccamttcttgtctcatgccttcvaagttgtttgctggcttggtccatgtgaagcaatgcatcgtggmtcatcctgtgaatccgccatacta

SEQ ID NO: 1735 - DNA, 140 bp, Homo Sapiens
  Substantia nigra
  sig_peptide 39..104: Von Heijne matrix
  score 5.10
  misc_feature complement(47..141): seq LCSLPLSPSAVCP/AP; blastn; identity 93; region 236..330
  id R62451
  misc_feature complement(78..141): est; blastn; identity 100; region 224..287
  id C14686
  misc_feature 78..141: est; blastn; identity 100; region 1..64
  id C15352
  misc_feature 78..141: est; blastn; identity 100; region 1..64
  id C15019
  misc_feature complement(78..141): est; blastn; identity 96; region 225..288; id C14869; est
acacacaaaaattttcctttgtttgcggggggctggggatgcagtgttttttggggggtcttggtttatgctccctgcccttgagcccctcagccgtttgccctgcccccacctcggctccatggtgggagggggctctg

SEQ ID NO: 1736 - DNA, 363 bp, Homo Sapiens
  Substantia nigra
  sig_peptide 175..213: Von Heijne matrix
  score 4.90
  misc_feature 37..288: seq MSSFLLSFSQSLS/NV; blastn; identity 99; region 4..255
  id R13070
  misc_feature 287..353: est; blastn; identity 98; region 255..321
  id R13070
  unsure 8: est
  position 8 of amino acid sequence
  unsure 36: Xaa = Leu,Trp; position 36 of amino acid sequence; Xaa = Ala,Gly
actctttactcccctgtgagtgattcactgccttgtcattattacgatagatgtgtttgtattgtkttttttctgatgatactgatgttgatgaatttttaattttatttgatgtggtagagttgggaggtttcagggttttttcccctcttttactttccattgaggaagggaatgagctcctttctcctctccttcagccaatcattatcaaatgttccttcagccctgcagtkgccccaaataaccttttttcagcatcctctgtcctcagtcatgccagtctggacatgctctgttgtgccctgtgacaaaactgstcagtattcctattgcttttactgtgttttaggtactgtgaag

SEQ ID NO: 1737 - DNA, 379 bp, Homo Sapiens
  Substantia nigra
  sig_peptide 152..190: Von Heijne matrix
  score 4.90
  misc_feature complement(216..354): seq MLTASLAFQLVDG/VS; blastn; identity 98; region 82..220
  id W28597
  misc_feature complement(351..381): est; blastn; identity 93; region 54..84
  id W28597
  misc_feature 216..347: est; blastn; identity 99; region 121..252
  id T90405
  misc_feature 249..310: est; blastn; identity 90; region 141..202
  id AA085837
  misc_feature 293..338: est; blastn; identity 95; region 186..231
  id AA085837
  misc_feature 216..248: est; blastn; identity 96; region 107..139
  id AA085837
  misc_feature 351..381: est; blastn; identity 93; region 246..276
  id AA085837
  unsure 55: est; position 55 of amino acid sequence; Xaa = Ala,Gly
agaatctgctcgctcttctggagctgagacactcatcttctcctgccctggcacatcaaaactccaggttctctgatctttgaacactgggacttaatccagcatccccttactgcctgaagttctcaggactttggacttggactgaacgatgctaacagcttccctggctttccagcttgtagatggcgtatcatggaatttctcagtctccaaaatgctggcatcaccatctacatcaggtcagctgtctcagtttggggcaagtttatacgggcaacaaagtgcactaggccttccaatgagggggatgagcaacaatacccctcagttaaatcgcagcttatcacaagsactcagttaccgagccacgtcacgc

SEQ ID NO: 1738 - DNA, 198 bp, Homo Sapiens
  Substantia nigra
  sig_peptide 118..192: Von Heijne matrix
  score 4.90
  misc_feature complement(2..132): seq LSAFNFLVCLSLG/RG; blastn; identity 99; region 105..235
  id T58540
  unsure -23: est; position -23 of amino acid sequence; Xaa =  * ,Tyr
atatgatgctggcaagacacccagaaaggctattttcagatgaaatcgatattagaagctatattagctgaaacaactccttttactgcgtagaacctatatcgagagtgtgtgtatatgtattawaggagggagctctcaattttatgtattctttctgcctttaattttcttgtttgtttgagcttagggagaggg

SEQ ID NO: 1739 - DNA, 292 bp, Homo Sapiens
  Substantia nigra
  sig_peptide 206..271: Von Heijne matrix
  score 4.80
  misc_feature 56..93: seq IVFGVSWVMLVYS/AS; blastn; identity 97; region 213..250
  id N58549
  est
  misc_feature 292: n=a, g, c or t
  unsure 7: position 7 of amino acid sequence; Xaa = Asp,Glu,Gly
atgwaggctgttgttcagattcctttgtcccatggggtgttcccttattatagtactctcgcccttttcctatggatgtggcttcctgagagcggmstgatastgattgtkatctttcttktggatctasccacccagctattctaccakgctctgggctggtactggcggttgtctgcacagagtcttgtgacctgaaccatctatgggtctctcwgccatggataccagcatagtatttggggtgtcctgggtcatgctggtgtactctgcttccttcaggaggtgtgrn

SEQ ID NO: 1740 - DNA, 307 bp, Homo Sapiens
  Substantia nigra
  sig_peptide 101..295: Von Heijne matrix
  score 4.80
  misc_feature complement(80..196): seq IILFSAIVGFIYG/YV; blastn; identity 100; region 68..184
  id R85971
  misc_feature complement(31..86): est; blastn; identity 96; region 179..234
  id R85971
  misc_feature complement(80..196): est; blastn; identity 100; region 68..184
  id R85965
  misc_feature complement(31..86): est; blastn; identity 96; region 179..234
  id R85965
  misc_feature 205..305: est; blastn; identity 95; region 128..228
  id N33907
  misc_feature 205..305: est; blastn; identity 95; region 99..199
  id T19230
  misc_feature 205..305: est; blastn; identity 95; region 96..196; id T31783; est
aaaaaaggtcaaggtagcctcctccaaactccacgttgagctgcacctcccctgagctcccacatctgggcctccctctcccagggctaatccagctgtcatgtatttctggcgtgatgtggctgtctcccttgacacgctctgggctcttccaaggcaacagcctggtcttggtaacaaccgtgtcctcggtctgctgtctggcacaaacaaggattacaagggccagaagctagctgaacagatgtttcagggaattattcttttttctgcaatagttggatttatctacgggtacgtggccgcg

SEQ ID NO: 1741 - DNA, 260 bp, Homo Sapiens
  Substantia nigra
  sig_peptide 99..176: Von Heijne matrix
  score 4.70
  misc_feature 24..261: seq LLICXLXIGTATP/VR; blastn; identity 92; region 1..238
  id HSC29G021
  unsure -19: est
  position -19 of amino acid sequence
  unsure -17,13: Xaa = Ala,Thr
  position -17, -13 of amino acid sequence
  unsure -16: Xaa = Ile,Val
  position -16 of amino acid sequence
  unsure -9: Xaa = Glu,Val
  position -9 of amino acid sequence
  unsure -7: Xaa = Asp,Gly
  position -7 of amino acid sequence
  unsure 3: Xaa =  * ,Trp; position 3 of amino acid sequence; Xaa = Glu,Gly
attacgcagagagaaagttacgaggttcgtggccgcggtttccccaggcagctggcgctggaggcttcggcgtcacgtgctggtctggrtttttctcgatgcactggggaaagcggtggrctcttrtcgwrggagggctcttgatctgtgrtttatrgataggcacagctactcccgttcgggracccaacggcagacaggtsctagtgcccrtcggwtacccgcggccgggactcggagctgtggggtgtggggaggcg

SEQ ID NO: 1742 - DNA, 416 bp, Homo Sapiens
  Substantia nigra
  sig_peptide 309..395: Von Heijne matrix
  score 4.60
  misc_feature 158..364: seq ALGLXTCLSVLFG/YA; blastn; identity 91; region 153..359
  id N25870
  misc_feature 358..416: est; blastn; identity 91; region 355..413
  id N25870
  misc_feature 148..332: est; blastn; identity 91; region 134..318
  id AA045920
  misc_feature 332..395: est; blastn; identity 93; region 319..382
  id AA045920
  misc_feature 205..416: est; blastn; identity 94; region 1..212
  id AA150024
  misc_feature 148..315: est; blastn; identity 90; region 133..300
  id H99323
  misc_feature 352..403: est; blastn; identity 92; region 337..388
  id H99323
  misc_feature complement(202..384): est; blastn; identity 93; region 215..397
  id R83259
  unsure -27: est
  position -27 of amino acid sequence
  unsure -15,-9: Xaa = Pro,Thr; position -15, -9 of amino acid sequence; Xaa = Leu,Met
agcasggaacagcgggtgcggacattacggcggaaggctctsgaggaagcagaagtgaaggacctcgcastcctgggacggtggggcmcagasagagaaagggagccccgggcgcggcgcggtgaggatgcgagcagaggaaggacacgcggcgccgsaaaatatttacaccagcagctccagttcataccmmtaaagamsatcctgctacccamactamtttgggatttatccmygcatttgtcgctgccatatcagttattattgtatctgaattgggtgataagacattttttatagcagccatcatggcamcgcgctataaccgcctgaccgtgctggctggtgcmmtgcttgccttgggactamtgacatgcytgtcagttttgtttggctatgcaccacagtcatcccca

SEQ ID NO: 1743 - DNA, 247 bp, Homo Sapiens
  Substantia nigra
  sig_peptide 143..229: Von Heijne matrix
  score 4.50
  misc_feature 55..152: seq FMTCILCRPPISS/CV; blastn; identity 92; region 188..285
  id N94950
  misc_feature 54..152: est; blastn; identity 90; region 122..220
  id T09182
  misc_feature 170..233: est; blastn; identity 90; region 296..359
  id N71787
  misc_feature complement(54..142): est; blastn; identity 93; region 199..287; id T64627; est
acagatctgagggttcctcgcctttttagaccatatagggtagccttctgatgtgccatggtatttgtaaactgtcatggtgctgttgggagtgtagcagtgaggacgaccagaggtcactcttgtcgccatcttggttttgatgggttttactggcttctttactgcaacctgttttatcagcaaggtctttatgacctgtatcttgtgcagacctcctatctcatcctgtgtcttagaatgcggg

SEQ ID NO: 1744 - DNA, 383 bp, Homo Sapiens
  brain
  sig_peptide 258..362: Von Heijne matrix
  score 4.40
  misc_feature complement(61..347): seq LIVLLPVLFFSLK/NF; blastn; identity 100; region 88..374
  id W84548
  misc_feature complement(1..48): est; blastn; identity 100; region 387..434
  id W84548
  misc_feature complement(61..282): est; blastn; identity 98; region 154..375
  id N66815
  misc_feature complement(279..347): est; blastn; identity 100; region 88..156
  id N66815
  misc_feature complement(12..48): est; blastn; identity 94; region 388..424
  id N66815
  misc_feature complement(89..282): est; blastn; identity 98; region 155..348
  id N24160
  misc_feature complement(279..347): est; blastn; identity 100; region 89..157
  id N24160
  misc_feature complement(200..347): est; blastn; identity 98; region 88..235
  id N66833
  misc_feature complement(239..347): est; blastn; identity 95; region 11..119
  id H88111
  misc_feature complement(208..239): est; blastn; identity 96; region 120..151; id H88111; est
aacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacacag

SEQ ID NO: 1745 - DNA, 349 bp, Homo Sapiens
  Substantia nigra
  sig_peptide 176..286: Von Heijne matrix
  score 4.30
  misc_feature 63..281: seq LWEKLTLLSPGIA/VT; blastn; identity 96; region 1..219
  id R06709
  misc_feature 166..336: est; blastn; identity 96; region 104..274
  id W92876
  misc_feature 63..165: est; blastn; identity 97; region 2..104
  id W92876
  misc_feature 165..351: est; blastn; identity 97; region 63..249
  id N31364
  misc_feature 102..165: est; blastn; identity 98; region 1..64
  id N31364
  misc_feature 166..351: est; blastn; identity 97; region 64..249
  id N75642
  misc_feature 105..165: est; blastn; identity 100; region 4..64
  id N75642
  misc_feature complement(269..324): est; blastn; identity 96; region 259..314
  id W92774
  misc_feature complement(322..351): est; blastn; identity 93; region 231..260
  id W92774
  est
  misc_feature 61: n=a, g, c or t
  unsure -31: position -31 of amino acid sequence
  unsure -27: Xaa = Phe,Leu
  position -27 of amino acid sequence
  unsure 12: Xaa = Arg,Thr; position 12 of amino acid sequence; Xaa =  * ,Tyr
aagtaaacatgagcctctggtagataagagaaaccgcgatcggagtacggcgcgtgcgwgnatcagggatcgcgattgcgaatcctccgctgaggtgatttggatatccctagaacgttgagggcacgagtcgggtcctgagaccaggtcctcagccagcagagccacgttccttatgagcaccgtgggtttattkcattttcctasrccactgacccgaatatgcccggcgccatggggactccggctttgggagaagctgacgttgttatccccaggaatagctgtsactccggtccagatggcaggcaagaaggactascctgcactgctttccttggatgagaat

SEQ ID NO: 1746 - DNA, 268 bp, Homo Sapiens
  Substantia nigra
  sig_peptide 32..70: Von Heijne matrix
  score 4.30
  misc_feature 64..107: seq MLALAXHLSTVES/EK; blastn; identity 97; region 336..379
  id AA100380
  est
  misc_feature 49: n=a, g, c or t
  unsure -8: position -8 of amino acid sequence; Xaa = Arg,Ser,Thr
cattgagctcgggctgagtgaggcccaggtgatgctggctctagccasncacctgagcacagtggagtcggagaaacagaagctgcgggctcaggtgcggcggctatgccaggagaaccagtggctgcgggatgagctggctggcacccagcagcggctacagcgcagtgaacaggctgtggctcagctggaggaggaaaagaagcacctggagttcctggggcagctgcggcagtatgatgaggatggacatacctcggaggcgggg

SEQ ID NO: 1747 - DNA, 305 bp, Homo Sapiens
  brain
  sig_peptide 147..248: Von Heijne matrix
  score 4.30
  misc_feature 14..122: seq QLFAFLNLLPVEA/DI; blastn; identity 100; region 1..109
  id HUM429E03B
  misc_feature 114..230: est; blastn; identity 95; region 100..216
  id HUM429E03B
  misc_feature 226..307: est; blastn; identity 96; region 211..292
  id HUM429E03B
  misc_feature 114..274: est; blastn; identity 92; region 85..245
  id T31768
  misc_feature 29..122: est; blastn; identity 98; region 1..94
  id T31768
  misc_feature 262..307: est; blastn; identity 95; region 234..279
  id T31768
  misc_feature 103..307: est; blastn; identity 93; region 95..299
  id T80259
  misc_feature 21..120: est; blastn; identity 95; region 15..114
  id T80259
  misc_feature 114..307: est; blastn; identity 95; region 68..261
  id N32697
  misc_feature 45..87: est; blastn; identity 95; region 1..43
  id N32697
  misc_feature 92..122: est; blastn; identity 93; region 47..77
  id N32697
  misc_feature 114..307: est; blastn; identity 96; region 59..252
  id N44613
  misc_feature 55..122: est; blastn; identity 94; region 1..68
  id N44613
  unsure -24: est; position -24 of amino acid sequence; Xaa =  * ,Ser
agtcgtccctgctagtactccgggctgtgggggtcggtgcggatattcagtcatgaaatcagggtagggacttctcccgcagcgacgcggctggcaagactgtttgtgttgcgggggccggaacttcaaggtgattttacaacgagatgctgctctccatagggatgctcatgctgtsagccacacaagtctacaccatcttgactgtccagctctttgcattcttaaacctactgcctgtagaagcagacattttagcatataactttgaaaatgcatctcagacatttgatgacctccccgca

SEQ ID NO: 1748 - DNA, 333 bp, Homo Sapiens
  brain
  sig_peptide 106..216: Von Heijne matrix
  score 4.30
  misc_feature 95..297: seq LWEKLTLLSPGIA/VT; blastn; identity 98; region 63..265
  id N31364
  misc_feature 32..95: est; blastn; identity 98; region 1..64
  id N31364
  misc_feature 293..329: est; blastn; identity 100; region 262..298
  id N31364
  misc_feature 2..211: est; blastn; identity 98; region 10..219
  id R06709
  misc_feature 203..235: est; blastn; identity 90; region 212..244
  id R06709
  misc_feature 96..329: est; blastn; identity 97; region 64..297
  id N75642
  misc_feature 35..95: est; blastn; identity 100; region 4..64
  id N75642
  misc_feature 96..266: est; blastn; identity 99; region 104..274
  id W92876
  misc_feature 2..95: est; blastn; identity 96; region 11..104
  id W92876
  misc_feature complement(252..329): est; blastn; identity 97; region 183..260
  id W92774
  misc_feature complement(199..254): est; blastn; identity 100; region 259..314
  id W92774
  unsure 21: est; position 21 of amino acid sequence; Xaa = Asp,His,Asn
agcgattgcgaatcctccgctgaggtgatttggatatccctagaacgttgagggcacgagtcgggtcctgagaccaggtcctcagccagcagagccacgttccttatgagcaccgtgggtttatttcattttcctacaccactgacccgaatatgcccggcgccatggggactccggctttgggagaagctgacgttgttatccccaggaatagctgtcactccggtccagatggcaggcaagaaggactaccctgcactgctttccttggatgagvatgaactcgaagagcagtttgtgaaaggacacggtccagggggccaggcaacgcgg

SEQ ID NO: 1749 - DNA, 510 bp, Homo Sapiens
  Substantia nigra
  sig_peptide 16..114: Von Heijne matrix
  score 4.20
  misc_feature 188..485: seq LLNFLGLWSWICK/KW; blastn; identity 95; region 171..468
  id R76663
  misc_feature 17..186: est; blastn; identity 100; region 1..170
  id R76663
  misc_feature 183..367: est; blastn; identity 98; region 169..353
  id H67124
  misc_feature 14..185: est; blastn; identity 100; region 1..172
  id H67124
  misc_feature 214..430: est; blastn; identity 98; region 81..297
  id R53683
  misc_feature 133..227: est; blastn; identity 93; region 1..95; id R53683; est
attcccttctgagcaatggagcttaccatctttatcctgagactggccatttacatcctgacatttcccttgtacctgctgaactttctgggcttgtggagctggatatgcaaaaaatggttcccctacttcttggtgaggttcactgtgatatacaacgaacagatggcaagcaagaagcgggagctcttcagtaacctgcaggagtttgcgggcccctccgggaaactctccctgctggaagtgggctgtggcacgggggccaacttcaagttctacccacctgggtgcagggtgacctgtattgaccccaaccccaactttgagaagtttttgatcaagagcattgcagagaaccgacacctgcagtttgagcgctttgtggtagctgccggggagaacatgcaccaggtggctgatggctctgtggatgtggtggtctgcaccctggtgctgtgctctgtgaagaaccaggagcggattctccgcgaggtgtgcagagtgctgaga

SEQ ID NO: 1750 - DNA, 155 bp, Homo Sapiens
  Substantia nigra
  sig_peptide 9..119: Von Heijne matrix
  score 4.10
  misc_feature complement(2..122): seq LLLYLCCMINIHH/LP; blastn; identity 96; region 9..129
  id R16550
  misc_feature 85..150: est; blastn; identity 100; region 1..66; id N42850; est
attgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccaaggg

SEQ ID NO: 1751 - DNA, 250 bp, Homo Sapiens
  brain
  sig_peptide 122..172: Von Heijne matrix
  score 3.90
  misc_feature complement(90..123): seq ISYFIAFPNLSQA/EL; blastn; identity 97; region 1..34; id H04995; est
ataatcatatttcaaaatgaatagcaaagaggtttataatcaagttttataaaaattccaaatgtaataaagttatatttgtaacttacatatactgcaaaaatggtagtgattcaaatgtatgtctttcaatatatcgtattttattgcctttccaaatctctcccaggcagaattaacacatcccaggtgctcttacacagggttgagtagttcctgtggatttcagttgagtgataccccccacagg

SEQ ID NO: 1752 - DNA, 379 bp, Homo Sapiens
  brain
  sig_peptide 302..361: Von Heijne matrix
  score 3.70
  misc_feature 193..356: seq LTIILLPVHLLIT/IY; blastn; identity 98; region 131..294
  id AA148880
  misc_feature 93..193: est; blastn; identity 97; region 30..130
  id AA148880
  misc_feature 63..97: est; blastn; identity 91; region 1..35
  id AA148880
  misc_feature 122..307: est; blastn; identity 98; region 131..316
  id H92506
  misc_feature 9..97: est; blastn; identity 92; region 1..89
  id H92506
  unsure -16: est; position -16 of amino acid sequence; Xaa = Leu,Gln
actttttgcgagctttccgagtgccaggcgccggccggctgcgaagacgcggtgggccgcccctccgattgaaatcacagaagatattcgkgktccttcttaagagaaaaagaggacatttgcgtactttattgtcggcttccaaagattactaacttttatctgtatcactaagattgaactgccttggctgtactgctattcttactgctgcttctattattgccttcttcagcacaataaggctttcaaaagccaaagaataacaagaaataagcaccattttagaagcctttccactatgaaacttaagcwaaatgtgctcaccattattttgctgcctgtccacttgttaataacaatatacagtgcccttata

SEQ ID NO: 1753 - DNA, 176 bp, Homo Sapiens
  Substantia nigra
  sig_peptide 9..50: Von Heijne matrix
  score 3.70
  misc_feature 25..173: seq AALVTVLFTGVRR/LH; blastn; identity 91; region 67..215
  id H46464
  misc_feature 73..173: est; blastn; identity 96; region 44..144
  id C17500
  misc_feature 32..67: est; blastn; identity 94; region 1..36
  id C17500
  misc_feature complement(112..173): est; blastn; identity 96; region 215..276
  id AA143237
  misc_feature complement(65..117): est; blastn; identity 90; region 270..322
  id AA143237
  misc_feature complement(125..173): est; blastn; identity 95; region 241..289
  id W57931
  misc_feature complement(8..50): est; blastn; identity 95; region 368..410
  id W57931
  unsure 6: est
  position 6 of amino acid sequence
  unsure 14: Xaa = Ala,Pro; position 14 of amino acid sequence; Xaa = Asp,Gly
agctcagcatggctgctttagtgactgttctcttcacaggtgtccggaggctgcactgcagcgcrscgcttgggcgggcggccagtggcgrctacagcaggaactggctgccaacccctccggctacgggccccttaccgagctcccagactggtcatatgcggatggccgccagg

SEQ ID NO: 1754 - DNA, 236 bp, Homo Sapiens
  Surrenals
  sig_peptide 6..131: Von Heijne matrix
  score 3.70
  misc_feature 85..236: seq ILMRDFSPSGIFG/AF; blastn; identity 96; region 91..242
  id AA031580
  misc_feature 3..87: est; blastn; identity 100; region 10..94
  id AA031580
  misc_feature 85..236: est; blastn; identity 96; region 82..233
  id W80981
  misc_feature 3..87: est; blastn; identity 100; region 1..85
  id W80981
  misc_feature 90..236: est; blastn; identity 97; region 89..235
  id R69999
  misc_feature 3..88: est; blastn; identity 100; region 3..88
  id R69999
  misc_feature 90..236: est; blastn; identity 97; region 89..235
  id R76832
  misc_feature 3..88: est; blastn; identity 100; region 3..88
  id R76832
  misc_feature 90..236: est; blastn; identity 97; region 89..235
  id R80120
  misc_feature 3..88: est; blastn; identity 100; region 3..88
  id R80120
  unsure 7: est
  position 7 of amino acid sequence
  unsure 12: Xaa =  * ,Tyr
  position 12 of amino acid sequence
  unsure 17: Xaa = Glu,Lys,Gln
  position 17 of amino acid sequence
  unsure 25: Xaa = Glu,Lys; position 25 of amino acid sequence; Xaa = Asn,Thr
ataaaatggcgtcagttggtgagtgtccggccccagtaccagtgaaggacaagaaacttctggaggtcaaactgggggagctgccaagctggatcttgatgcgggacttcagtcctagtggcattttcggagcgtttcaaagaggttactascggtactacaacvagtacatcaatgtgragaaggggagcatctcggggattamcatggtgctggcatgctacgtgctctttagc

SEQ ID NO: 1755 - DNA, 155 bp, Homo Sapiens
  Surrenals
  sig_peptide 81..125: Von Heijne matrix
  score 10.90
  misc_feature 61..155: seq ALLVLVTVALASA/HH; blastn; identity 98; region 4..98
  id HUMPASP
  misc_feature 77..155: vrt; blastn; identity 98; region 1..79; id W44779; est
agcaatcaggagaagaaagcaaagaacactcaggattataaaagcagatgagacctacccactagacctggtcagacacaatgttggcactcttggttctggtgactgtggccctggcatctgctcatcatggtggtgagcactttgaaggcgcg

SEQ ID NO: 1756 - DNA, 214 bp, Homo Sapiens
  Substantia nigra
  sig_peptide 47..109: Von Heijne matrix
  score 8.90
  misc_feature 47..211: seq VLLFSGFWGLAMG/AF; blastn; identity 98; region 1..165
  id HSU16129
  misc_feature 3..211: vrt; blastn; identity 92; region 117..326
  id RATGLUR4A
  misc_feature 35..211: vrt; blastn; identity 91; region 1..177
  id GGGLUR4
  misc_feature 47..211: vrt; blastn; identity 93; region 1..165
  id RATAMPASGD
  misc_feature 47..211: vrt; blastn; identity 93; region 1..165
  id RATGLURD
  misc_feature 47..211: vrt; blastn; identity 93; region 1..165
  id S94371
  misc_feature 61..211: vrt; blastn; identity 100; region 93..243
  id R93859
  misc_feature 136..210: est; blastn; identity 98; region 1..75; id R16185; est
aagagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccggg

SEQ ID NO: 1757 - protein, 37 aa, Homo Sapiens
  Brain
  SIGNAL -14..-1: Von Heijne matrix; score 10.80; seq LLLLGLCLGLSLC/VG
MLLLLGLCLGLSLCVGSQEEAQSWGHSSEQDGLRVPR

SEQ ID NO: 1758 - protein, 79 aa, Homo Sapiens
  Brain
  SIGNAL -26..-1: Von Heijne matrix; score 10.80; seq VLLFFVLLGMSQA/GS
MENGGAGTLQIRQVLLFFVLLGMSQAGSETGNFLVMEELQSGSFVGNLAKTLGLEVSELSSRGARVVSNDNKECLQLDT

SEQ ID NO: 1759 - protein, 129 aa, Homo Sapiens
  Brain
  SIGNAL -126..-1: Von Heijne matrix; score 10.00; seq LKLLLFLSTELQA/SQ
MRGPEPGPQPTMEGDVLDTLEALGYKGPLLEEQALTKAAEGGLSSPEFSELCIWLGSQIKSLCNLEESITSAGRDDLESFQLEISGFLKEMACPYSVLISGDIKDRLKKKEDCLKLLLFLSTELQASQI

SEQ ID NO: 1760 - protein, 44 aa, Homo Sapiens
  Brain
  SIGNAL -26..-1: Von Heijne matrix; score 9.60; seq WLIALASWSWALC/RI
MEKSWMLWNFVERWLIALASWSWALCRISLLPLIVTFHLYGGSG

SEQ ID NO: 1761 - protein, 89 aa, Homo Sapiens
  Brain
  SIGNAL -36..-1: Von Heijne matrix; score 9.50; seq LGLLLLARHWCIA/GV
MQQTRTEAVAGAFSHCLGFCGMRLGLLLLARHWCIAGVFPQKFDGDSAYVGMSDGNPELLSTSQTYNGQSENNEDYEIPPITPPNLPEA

SEQ ID NO: 1762 - protein, 53 aa, Homo Sapiens [sequence omitted]

SEQ ID NO: 1763 - protein, 79 aa, Homo Sapiens
  Brain
  SIGNAL -24..-1: Von Heijne matrix; score 9.00; seq LLMLIVFHAASMA/LQ
MFPFNQAGLPTLLMLIVFHAASMALQRLFLFALVWHSKPSGLMTGKLESQIPHEKLTHISVMHGPLSSHHSYTHIHLFL

SEQ ID NO: 1764 - protein, 99 aa, Homo Sapiens [sequence omitted]

SEQ ID NO: 1765 - protein, 68 aa, Homo Sapiens
  Brain
  SIGNAL -53..-1: Von Heijne matrix
  score 8.80
  seq ILLLLTVLPCIXM/GQ
  UNSURE -38: Xaa =  * ,Gly
  UNSURE -2,11: Xaa = Gly,Arg
MWTASAMDFRTCIASXLPALCYVQACRALMIAASVLGLPAILLLLTVLPCIXMGQEPGVAKYRXAQLA

SEQ ID NO: 1766 - protein, 86 aa, Homo Sapiens [sequence omitted]

SEQ ID NO: 1767 - protein, 19 aa, Homo Sapiens
  Brain
  SIGNAL -16..-1: Von Heijne matrix; score 8.50; seq LLTFLAFTTLLFA/PP
MFCLLTFLAFTTLLFAPPW

SEQ ID NO: 1768 - protein, 80 aa, Homo Sapiens [sequence omitted]

SEQ ID NO: 1769 - protein, 23 aa, Homo Sapiens [sequence omitted]

SEQ ID NO: 1770 - protein, 47 aa, Homo Sapiens
  Brain
  SIGNAL -35..-1: Von Heijne matrix; score 8.30; seq AAMLIGLLAWLQT/VP
MSVLDDRQRDILVVQKRHSSLEAAMLIGLLAWLQTVPAHGCQFLPIR

SEQ ID NO: 1771 - protein, 38 aa, Homo Sapiens [sequence omitted]

SEQ ID NO: 1772 - protein, 43 aa, Homo Sapiens [sequence omitted]

SEQ ID NO: 1773 - protein, 136 aa, Homo Sapiens
  Brain
  SIGNAL -109..-1: Von Heijne matrix
  score 8.20
  seq LLRLPQLPPXCSA/GE
  UNSURE -4: Xaa = Gly,Val
MDPRGILKAFPKRQKIHADASSKVLAKIPRREEGEEAEEWLSSLRAHVVRTGIGRARAELFEKQIVQHGGQLCPAQGPGVTHIVVDEGMDYERALRLLRLPQLPPXCSAGEVSLAELVPSGEEAGGCSWIQHLHPS

SEQ ID NO: 1774 - protein, 26 aa, Homo Sapiens
  Brain
  SIGNAL -21..-1: Von Heijne matrix; score 8.00; seq LFLVAVLVKVAEA/RK
MFWKLSLSLFLVAVLVKVAEARKNRS

SEQ ID NO: 1775 - protein, 26 aa, Homo Sapiens
  Brain
  SIGNAL -18..-1: Von Heijne matrix; score 7.90; seq LFSLLVLQSMATG/AT
MAFLGLFSLLVLQSMATGATFPEEAP

SEQ ID NO: 1776 - protein, 70 aa, Homo Sapiens
  Brain
  SIGNAL -18..-1: Von Heijne matrix; score 7.90; seq LFSLLVLQSMATG/AT
MAFLGLFSLLVLQSMATGATFPEEAIADLSVNMYNRLRAVGSWRREGASRQIASCLPAFLLHLPLTHTHG

SEQ ID NO: 1777 - protein, 103 aa, Homo Sapiens
  Brain
  SIGNAL -55..-1: Von Heijne matrix; score 7.80; seq ALLVALLFTLIHR/RR
MSFSLNFTLPANTTSSPVTGGKETDCGPSLGLAAGIPLLVATALLVALLFTLIHRRRSSIEAMEESDRPCEISEIDDNPKISENPRRSPTHEKNTMGAQEARW

SEQ ID NO: 1778 - protein, 82 aa, Homo Sapiens
  Brain
  SIGNAL -80..-1: Von Heijne matrix; score 7.70; seq LVLFLSLALLVTP/TS
MSTWYLALNKSYKNKDSVRIYLSLCTVSIKFTYFHDIQTNCLTTWKHSRCRFYWAFGGSILQHSVDPLVLFLSLALLVTPTS

SEQ ID NO: 1779 - protein, 43 aa, Homo Sapiens [sequence omitted]

SEQ ID NO: 1780 - protein, 74 aa, Homo Sapiens
  Brain
  SIGNAL -19..-1: Von Heijne matrix
  score 7.60
  seq LLNLLLLSLFAGL/DP
  UNSURE 26: Xaa =  * ,Gly,Arg
MQATSNLLNLLLLSLFAGLDPSKNKKRGSSFSFKFPLLDDTPFLXSRIENSATHHLHYGLNMILWVNWKPKLTL

SEQ ID NO: 1781 - protein, 34 aa, Homo Sapiens
  Brain
  SIGNAL -31..-1: Von Heijne matrix; score 7.60; seq VTLLCGWPGSHWC/AP
MMKWKPEDLGSVPCEAFSVTLLCGWPGSHWCAPP

SEQ ID NO: 1782 - protein, 78 aa, Homo Sapiens
  Brain
  SIGNAL -19..-1: Von Heijne matrix; score 7.60; seq LLNLLLLSLFAGL/DP
MQATSNLLNLLLLSLFAGLDPSKTQISPKEGWQVYSSAQDPDGRCICTVVAPEQNLCSRDAKSRQLRQLLEKVQNMSR

SEQ ID NO: 1783 - protein, 80 aa, Homo Sapiens
  Brain
  SIGNAL -48..-1: Von Heijne matrix; score 7.50; seq FVILLLFIFTVVS/LV
MASSHWNETTTSVYQYLGFQVQKIYPFHDNWNTACFVILLLFIFTVVSLVVLAFLYEVLDCCCCVKNKTVKDLKSEPNPR

SEQ ID NO: 1784 - protein, 35 aa, Homo Sapiens
  Brain
  SIGNAL -33..-1: Von Heijne matrix; score 7.40; seq ITCCVLLLLNCSG/VW
MLWFSGVGALAERYCRRSPGITCCVLLLLNCSGVW

SEQ ID NO: 1785 - protein, 31 aa, Homo Sapiens [sequence omitted]

SEQ ID NO: 1786 - protein, 36 aa, Homo Sapiens
  Brain
  SIGNAL -27..-1: Von Heijne matrix
  score 7.20
  seq LLLGLCSPPXXSL/AS
  UNSURE -4: Xaa = Arg,Ser
  UNSURE -23: Xaa = Asp,Glu
  UNSURE -3: Xaa = Ile,Val
  UNSURE -22: Xaa = Leu,Met,Val
MELRXXPPGGREVQLLLGLCSPPXXSLASFPKAAQM

SEQ ID NO: 1787 - protein, 24 aa, Homo Sapiens [sequence omitted]

SEQ ID NO: 1788 - protein, 112 aa, Homo Sapiens
  Brain
  SIGNAL -52..-1: Von Heijne matrix
  score 7.00
  seq SVWLCLLCYFAFP/FQ
  UNSURE 36: Xaa =  * ,Gly,Ile,Leu,Arg,Val
  UNSURE 14: Xaa = Cys,Gly,Arg,Ser
  UNSURE 35: Xaa = His,Gln,Arg
  UNSURE -34: Xaa = Ile,Arg,Ser
MDISGLIPGLVSTFILLSXSDHYGRKFPMILSSVGALATSVWLCLLCYFAFPFQLLIASTFIGAFXGNYTTFWGACFAYIVDQCKEXXQKTIRIAIIDFLLGLVTGLTVLSS

SEQ ID NO: 1789 - protein, 36 aa, Homo Sapiens
  Brain
  SIGNAL -30..-1: Von Heijne matrix
  score 7.00
  seq LFVILLITSLIFC/SL
  UNSURE -29: Xaa =  * ,Leu
MXVFFSKNRFEMYFSLLLFVILLITSLIFCSLYVAR

SEQ ID NO: 1790 - protein, 34 aa, Homo Sapiens
  Brain
  SIGNAL -23..-1: Von Heijne matrix; score 6.90; seq SLSLLASHHSVSC/SN
MPVPACWISSSLSLLASHHSVSCSNIFLNFNPDR

SEQ ID NO: 1791 - protein, 59 aa, Homo Sapiens
  Brain
  SIGNAL -21..-1: Von Heijne matrix
  score 6.90
  seq LLACGSLLPGLWQ/HL
  UNSURE 12: Xaa = Ala,Pro
MCPVFSKQLLACGSLLPGLWQHLTANHWPPFSXFLCTVCSGSSEQISEYTASATPPLCL

SEQ ID NO: 1792 - protein, 128 aa, Homo Sapiens [sequence omitted]

SEQ ID NO: 1793 - protein, 95 aa, Homo Sapiens [sequence omitted]

SEQ ID NO: 1794 - protein, 87 aa, Homo Sapiens
  Brain
  SIGNAL -29..-1: Von Heijne matrix; score 6.80; seq VLSLICSCFYTQP/HP
MASTISAYKEKMKELSVLSLICSCFYTQPHPNTVYQYGDMEVKQLDKRASGQSFEVILKSPSDLSPESPMLSSPPKKKDTSLEELQK

SEQ ID NO: 1795 - protein, 120 aa, Homo Sapiens
  Brain
  SIGNAL -114..-1: Von Heijne matrix; score 6.70; seq LIPMAILLGQTQS/NS
MLQVYGKPVYQGHRSTLKKGPYLRFNSPSPKSRPQRPKVIERVKGTKVKSIRTQTDFYATKPKKMDSKMKHSVPVLPHGDQQYLFSPSREMPTFSGTLEGHLIPMAILLGQTQSNSDTMP

SEQ ID NO: 1796 - protein, 127 aa, Homo Sapiens
  Brain
  SIGNAL -118..-1: Von Heijne matrix; score 6.70; seq LLFAKLFGHLTSA/RR
MSVLEISGMIMNRVNSHIPGIGYQIFGNAVSLILGLTPFVFRLSQATDLEQLTAHSASELYVIAFGSNEDVIVLSMVIISFVVRVSLVWIFFFLLCVAERTYKQRLLFAKLFGHLTSARRARKSEVP

SEQ ID NO: 1797 - protein, 71 aa, Homo Sapiens
  Brain
  SIGNAL -69..-1: Von Heijne matrix; score 6.70; seq FFKLLLLGAMCSG/AR
MCKGIKAGDTCEKLVGYSAVYRVCFGMACFFFIFCLLTLKINNSKSCRAHIHNGFWFFKLLLLGAMCSGAR

SEQ ID NO: 1798 - protein, 114 aa, Homo Sapiens
  Brain
  SIGNAL -104..-1: Von Heijne matrix; score 6.60; seq HFSHVVWFHPTWA/QQ
MSDSAGGRAGLRRYPKLPVWVVEDHQEVLPFIYRAIGSKHLPASNVSFLHFDSHPDLLIPVNMPADTVFDKETLFGELSIENWIMPAVYAGHFSHVVWFHPTWAQQIREGRHHF

SEQ ID NO: 1799 - protein, 109 aa, Homo Sapiens
  Brain
  SIGNAL -47..-1: Von Heijne matrix
  score 6.30
  seq SSCVLLTALVALA/AY
  UNSURE 50: Xaa =  * ,Ile,Lys,Leu,Arg,Ser,Thr
  UNSURE 33: Xaa = Asp,Asn
  UNSURE 42: Xaa = Asp,Gly,His,Arg
  UNSURE 29,36: Xaa = His,Gln
  UNSURE 30: Xaa = His,Lys,Asn,Pro,Gln,Thr
  UNSURE 49: Xaa = Ile,Leu
  UNSURE 31: Xaa = Ile,Leu,Val
  UNSURE 48: Xaa = Ile,Lys,Met,Asn,Arg,Ser,Thr
MSSCRGQKVAGGLRVVSPFPLCQPAGEPSRGKMRSSCVLLTALVALAAYYVYIPLPGSVSDPWKLMLLDATFRGAXXXSXLVXYLGLSXHLLALXXXLFLLAKKARGLL

SEQ ID NO: 1800 - protein, 72 aa, Homo Sapiens [sequence omitted]

SEQ ID NO: 1801 - protein, 60 aa, Homo Sapiens
  Brain
  SIGNAL -53..-1: Von Heijne matrix
  score 6.00
  seq ALILLLLAQKGPS/XF
  UNSURE 1: Xaa =  * ,Lys,Gln
MVCSAPRKIVVRAFITIIFIYYAIKKRANEPAAYLMLKPEALILLLLAQKGPSXFLLVWR

SEQ ID NO: 1802 - protein, 60 aa, Homo Sapiens
  Brain
  SIGNAL -40..-1: Von Heijne matrix
  score 5.90
  seq VCSALCSLGEVRP/XE
  UNSURE 13: Xaa = His,Gln
  UNSURE 1: Xaa = Leu,Met,Val
MTESSMKKLASTLLDAITDKDPLVQEQVCSALCSLGEVRPXETLRACEEYLRXMTSWHTR

SEQ ID NO: 1803 - protein, 59 aa, Homo Sapiens
  Brain
  SIGNAL -43..-1: Von Heijne matrix
  score 5.90
  seq VFLFHCTSGLSSC/KC
  UNSURE 7: Xaa = Phe,Leu,Ser
MQETDCNKRWGRGLGGLWSETGRRFHCKSFVFLFHCTSGLSSCKCSKKHXKYCFCFVAS

SEQ ID NO: 1804 - protein, 45 aa, Homo Sapiens
  Brain
  SIGNAL -17..-1: Von Heijne matrix
  score 5.80
  seq VPWLSSTVSCAQG/LR
  UNSURE 25: Xaa = Lys,Asn,Thr
MLLEVPWLSSTVSCAQGLRLAQHRVPFFYSNVSLCKLLLPAXLHG

SEQ ID NO: 1805 - protein, 105 aa, Homo Sapiens
  Brain
  SIGNAL -29..-1: Von Heijne matrix
  score 5.70
  seq SPAFLAVAGPGWA/RP
  UNSURE 5: Xaa = Ala,Ser,Thr
  UNSURE 71: Xaa = Lys,Met,Arg,Thr
MSGGRMQARCSQQSTWSPAFLAVAGPGWARPGCXLRTKYDSQLARHLLQPQFPGLTLGTLVQPAHWGMGGGTGGVLGEGGGHSYAEHGTCLQSCSTDVLXHVLLA

SEQ ID NO: 1806 - protein, 125 aa, Homo Sapiens
  Brain
  SIGNAL -18..-1: Von Heijne matrix; score 5.60; seq WHFLASFFPRAGC/HG
MLQMLWHFLASFFPRAGCHGSREGDDREVRGTPAPAWRDQMASFLGKQDGRAEATEKRPTILLVVGPAEQFPKKIVQAGDKDLDGQLDFEEFVHYLQDHEKKLRLVFKSLDKKNDGRIDAQEIMQ

SEQ ID NO: 1807 - protein, 37 aa, Homo Sapiens
  Brain
  SIGNAL -20..-1: Von Heijne matrix; score 5.60; seq SLVCLLAMGKGLG/SS
MYSHPVSSLVCLLAMGKGLGSSQALVQPDTWPHTSPR

SEQ ID NO: 1808 - protein, 92 aa, Homo Sapiens
  Brain
  SIGNAL -35..-1: Von Heijne matrix
  score 5.60
  seq FIFMEVLGSGAFS/EV
  UNSURE -25: Xaa = Ala,Ser,Thr
MGRKEEDDCSXWKKQTTNIRKTFIFMEVLGSGAFSEVFLVKQRLTGKLFALKCIKKSPAFRDSSLENEIAVLKKIKHENIVTLEDIYESTQG

SEQ ID NO: 1809 - protein, 48 aa, Homo Sapiens
  Brain
  SIGNAL -29..-1: Von Heijne matrix; score 5.60; seq LLPNQSLFSLARA/VR
MMIAVFGNANDRNVLTLLPNQSLFSLARAVRNHLLLEERRLTTYGVLC

SEQ ID NO: 1810 - protein, 58 aa, Homo Sapiens
  Brain
  SIGNAL -19..-1: Von Heijne matrix; score 5.60; seq LVVTAWFFGMCRS/KA
MFFELPLVVTAWFFGMCRSKALLGNARSALCLQTKACASSTQPDTHNEHHPRNPCPYL

SEQ ID NO: 1811 - protein, 54 aa, Homo Sapiens [sequence omitted]

SEQ ID NO: 1812 - protein, 53 aa, Homo Sapiens
  Brain
  SIGNAL -21..-1: Von Heijne matrix
  score 5.50
  seq LTGLCXCCLQALG/LA
  UNSURE -8: Xaa = Ala,Gly,Ser,Trp
MSCGSAASLTGLCXCCLQALGLAWRRRGLTGPGLPPVLQICCPRSLRGVTAPT

SEQ ID NO: 1813 - protein, 68 aa, Homo Sapiens
  Brain
  SIGNAL -46..-1: Von Heijne matrix; score 5.40; seq VLFFVGLITNGLA/MR
MQAVDNLTSAPGNTSLCTRDYKITQVLFPLLYTVLFFVGLITNGLAMRIFFQIRSKSNFIIFLKNTVK

SEQ ID NO: 1814 - protein, 28 aa, Homo Sapiens
  Brain
  SIGNAL -20..-1: Von Heijne matrix
  score 5.30
  seq LCSSCCSWGPAAG/AL
  UNSURE -15: Xaa = Pro,Arg
MAAAMXLLCSSCCSWGPAAGALQNPQRG

SEQ ID NO: 1815 - protein, 30 aa, Homo Sapiens
  Brain
  SIGNAL -25..-1: Von Heijne matrix; score 5.30; seq SVVKVLSLRKAQA/QS
MDFIKDQSLSHRSVVKVLSLRKAQAQSILE

SEQ ID NO: 1816 - protein, 75 aa, Homo Sapiens
  Brain
  SIGNAL -28..-1: Von Heijne matrix
  score 5.30
  seq RISCAFSLASSTA/RQ
  UNSURE 47: Xaa =  * ,Gly
MTRPFWASCSTWATSRISCAFSLASSTARQTSIACCATHRTAWASRPGPRRPWCCRYSKPLTTWPVRMMRREGSX

SEQ ID NO: 1817 - protein, 35 aa, Homo Sapiens
  Brain
  SIGNAL -16..-1: Von Heijne matrix; score 5.30; seq CAVSLTTAAVAFG/DE
MKSCAVSLTTAAVAFGDEAKKMAEGKASRESEEET

SEQ ID NO: 1818 - protein, 39 aa, Homo Sapiens [sequence omitted]

SEQ ID NO: 1819 - protein, 42 aa, Homo Sapiens
  Brain
  SIGNAL -15..-1: Von Heijne matrix
  score 5.20
  seq SGLSFLSVFSLWC/EP
  UNSURE 17: Xaa = Leu,Gln
MLSGLSFLSVFSLWCEPTLPALGNGSVLGVRXSSSSSAQCSL

SEQ ID NO: 1820 - protein, 87 aa, Homo Sapiens
  Brain
  SIGNAL -85..-1: Von Heijne matrix
  score 5.20
  seq LYSILHFPFWVHG/RX
  UNSURE 2: Xaa =  * ,Gln
  UNSURE -50: Xaa = Cys,Phe
MGLKDKSQAPASGLGVLRGQRSGSFISMPAPASGQXPEESRSPAPPVASRSQNRGYRPWHGPLWVHQSVRFGLYSILHFPFWVHGRX

SEQ ID NO: 1821 - protein, 67 aa, Homo Sapiens
  Brain
  SIGNAL -43..-1: Von Heijne matrix; score 5.20; seq PMQLLQVLSDVLA/EI
MSDQIKFIMDSLNKEPFRKNYNLITFDSLEPMQLLQVLSDVLAEIDPKVRVFSFFLMGSRKPISPSW

SEQ ID NO: 1822 - protein, 110 aa, Homo Sapiens
  Brain
  SIGNAL -104..-1: Von Heijne matrix; score 5.10; seq SSVASLTATPSLA/SP
MSPSCLHPDLWSMCLEVPSFTATDSVNCGCCLELATEPARNIRSTTRASLLRCSSFTSTRNSTGISALPPAAPMAWPFSASLSTLPVPLTHSSVASLTATPSLASPTRMM

SEQ ID NO: 1823 - protein, 24 aa, Homo Sapiens
  Brain
  SIGNAL -16..-1: Von Heijne matrix; score 5.10; seq SFHLLLDPSSTQS/SI
MDLSFHLLLDPSSTQSSILKHLPC

SEQ ID NO: 1824 - protein, 53 aa, Homo Sapiens
  Brain
  SIGNAL -26..-1: Von Heijne matrix
  score 5.00
  seq VISVLILVGFGAC/IY
  UNSURE 17: Xaa =  * ,Gln
  UNSURE -17: Xaa = Pro,Thr
MPHFLDWFVXVYLVISVLILVGFGACIYYFEPGLQEAHKWRMXRPWWTATSTG

SEQ ID NO: 1825 - protein, 39 aa, Homo Sapiens
  Brain
  SIGNAL -30..-1: Von Heijne matrix; score 5.00; seq IVGLLAQLEKINA/EP
MSKLKVIPEKSLTNNSRIVGLLAQLEKINAEPSESDTSR

SEQ ID NO: 1826 - protein, 43 aa, Homo Sapiens
  Brain
  SIGNAL -23..-1: Von Heijne matrix
  score 5.00
  seq LIPAMAFLSCVRP/ES
  UNSURE 3: Xaa = Arg,Trp
MMSASRLAGTLIPAMAFLSCVRPESXEPCVEVVPNITYQCMEL

SEQ ID NO: 1827 - protein, 65 aa, Homo Sapiens
  Brain
  SIGNAL -49..-1: Von Heijne matrix
  score 4.90
  seq VTVCCXLVAFLFC/IL
  UNSURE -31,-8: Xaa = Pro,Thr
MVDGTQLRGLTRMYQVPLXLDRDETLVRLRFTMVALVTVCCXLVAFLFCILWSLLFHFKETTATG

SEQ ID NO: 1828 - protein, 34 aa, Homo Sapiens [sequence omitted]

SEQ ID NO: 1829 - protein, 124 aa, Homo Sapiens
  Brain
  SIGNAL -59..-1: Von Heijne matrix; score 4.90; seq LVEMCLEVLGSSA/GD
MECQNSSLKKCLLVEKSLVKASYLIAFQTAASKKPFSIAEELIKPYLVEMCLEVLGSSAGDKMKTIPLSNVTIQHRIDELSADIEDQLIQKVRESKWFALQIDESSEISNITLLLCYIRFIDYD

SEQ ID NO: 1830 - protein, 27 aa, Homo Sapiens
  Brain
  SIGNAL -23..-1: Von Heijne matrix; score 4.80; seq VMWLVALLEMCVC/KK
MHSSIKTKGSVMWLVALLEMCVCKKSR

SEQ ID NO: 1831 - protein, 44 aa, Homo Sapiens [sequence omitted]

SEQ ID NO: 1832 - protein, 125 aa, Homo Sapiens
  Brain
  SIGNAL -30..-1: Von Heijne matrix
  score 4.80
  seq ILFCVGAVGACTL/SV
  UNSURE 58: Xaa = Asp,Glu
MGTASRSNIARHLQTNLILFCVGAVGACTLSVTQPWYLEVDYTHEAVTIKCTFSATGCPSEQPTCLWFRYGAHQPENLCLDGCKSEAXKFTVREALKENQVSLTVNRVTSNDSAIYICGIAFPSV

SEQ ID NO: 1833 - protein, 46 aa, Homo Sapiens
  Brain
  SIGNAL -25..-1: Von Heijne matrix; score 4.80; seq ALFYSVVVSTVSG/NE
MNSSKEEMRELAALFYSVVVSTVSGNELKSMIEQLIKTTKDNHSLR

SEQ ID NO: 1834 - protein, 81 aa, Homo Sapiens
  Brain
  SIGNAL -52..-1: Von Heijne matrix
  score 4.70
  seq LLAKALHLLKSSC/AP
  UNSURE -46: Xaa = Leu,Val
MSQDGGXGELKHMVMSFRVSELQVLLGFAGRNKSGRKHELLAKALHLLKSSCAPSVQMKIKELYRRRFPRKTLGPSDLSSG

SEQ ID NO: 1835 - protein, 47 aa, Homo Sapiens [sequence omitted]

SEQ ID NO: 1836 - protein, 47 aa, Homo Sapiens
  Brain
  SIGNAL -15..-1: Von Heijne matrix; score 4.70; seq IAVLFCFFLLIIF/QT
MKIAVLFCFFLLIIFQTDFGKNEEIPRKQRRKIYHRRLRKSSTSHKQ

SEQ ID NO: 1837 - protein, 48 aa, Homo Sapiens
  Brain
  SIGNAL -43..-1: Von Heijne matrix; score 4.70; seq STWSSASLRGSWQ/QG
MAKQKPHVLGSRVMPASCVSERRRKPSFQVSTWSSASLRGSWQQGMPG

SEQ ID NO: 1838 - protein, 17 aa, Homo Sapiens
  Brain
  SIGNAL -15..-1: Von Heijne matrix; score 4.60; seq FLYLKSVFDVSLG/AR
MGFLYLKSVFDVSLGAR

SEQ ID NO: 1839 - protein, 69 aa, Homo Sapiens
  Brain
  SIGNAL -61..-1: Von Heijne matrix
  score 4.60
  seq LLLLHGGGHSALS/WA
  UNSURE 8: Xaa = Lys,Arg
MRMGPGRKRDFSPVPWSQYFESMEDVEVENETGKDTFRVYKSGSEGPVLLLLHGGGHSALSWAVFTAAX

SEQ ID NO: 1840 - protein, 23 aa, Homo Sapiens [sequence omitted]

SEQ ID NO: 1841 - protein, 70 aa, Homo Sapiens
  Brain
  SIGNAL -61..-1: Von Heijne matrix; score 4.60; seq LLLLHGGGHSALS/WA
MRMGPGRKRDFSPVPWSQYFESMEDVEVENETGKDTFRVYKSGSEGPVLLLLHGGGHSALSWAVFTAATW

SEQ ID NO: 1842 - protein, 30 aa, Homo Sapiens [sequence omitted]

SEQ ID NO: 1843 - protein, 28 aa, Homo Sapiens [sequence omitted]

SEQ ID NO: 1844 - protein, 147 aa, Homo Sapiens
  Brain
  SIGNAL -101..-1: Von Heijne matrix; score 4.40; seq ISHILAFFAASDG/IV
MGDPERPEAAGLDQDERSSSDTNESEIKSNEEPLLRKSSRRFVIFPIQYPDIWKMYKQAQASFWTAEEVDLSKDLPHWNKLKADEKYFISHILAFFAASDGIVNENLVERFSQEVQVPEARCFYGFQILIENVHSEMYSLLIDTYIR

SEQ ID NO: 1845 - protein, 65 aa, Homo Sapiens [sequence omitted]

SEQ ID NO: 1846 - protein, 19 aa, Homo Sapiens [sequence omitted]

SEQ ID NO: 1847 - protein, 31 aa, Homo Sapiens [sequence omitted]

SEQ ID NO: 1848 - protein, 56 aa, Homo Sapiens
  Brain
  SIGNAL -47..-1: Von Heijne matrix; score 4.40; seq ISHILAFFAASDG/IV
MYKQAQASFWTAEEVDLSKDLPHWNKLKADEKYFISHILAFFAASDGIVNENLVER

SEQ ID NO: 1849 - protein, 48 aa, Homo Sapiens
  Brain
  SIGNAL -28..-1: Von Heijne matrix; score 4.30; seq FLGLAAMASPSRN/SQ
MLLHLCSVKNLYQNRFLGLAAMASPSRNSQSRRRCKEPLRYSYNPDQG

SEQ ID NO: 1850 - protein, 55 aa, Homo Sapiens
  Brain
  SIGNAL -18..-1: Von Heijne matrix; score 4.30; seq WTCLKSFPSPTSS/HA
MPCPTWTCLKSFPSPTSSHASSLHLPPSCTRLTLTQTLRTGMHLSRALQGTLTRQ

SEQ ID NO: 1851 - protein, 73 aa, Homo Sapiens
  Brain
  SIGNAL -33..-1: Von Heijne matrix
  score 4.30
  seq LLGWGLNLTLGQG/AP
  UNSURE 26: Xaa = Cys,Gly
  UNSURE -24: Xaa = Lys,Met
MEDLFSPSIXPPAPNISVPILLGWGLNLTLGQGAPASGPPSRRVRLVFLGVILVVAVAXNTTVLCRLCGGGGP

SEQ ID NO: 1852 - protein, 55 aa, Homo Sapiens
  Brain
  SIGNAL -52..-1: Von Heijne matrix; score 4.10; seq VMLETCGLLVSLG/HP
MAETKDAAQMLVTFKDVAVTFTREEWRQLDLAQRTLYREVMLETCGLLVSLGHPR

SEQ ID NO: 1853 - protein, 45 aa, Homo Sapiens
  Brain
  SIGNAL -13..-1: Von Heijne matrix; score 4.10; seq MLILSQNIAQLEA/QV
MLILSQNIAQLEAQVEKVTKEKISAINQLEENSKPAGFSGKWMSQ

SEQ ID NO: 1854 - protein, 97 aa, Homo Sapiens
  Brain
  SIGNAL -21..-1: Von Heijne matrix
  score 4.10
  seq GLWAHSWTCSCSA/AX
  UNSURE 2: Xaa = Leu,Val
MLLGASAQGLWAHSWTCSCSAAXRSVHPGGDWMQQFQAGFLPPQVPAHLSLTWDVSLLPPCLVPKALEFVVHFLKNDIFYLTQYIKNVISECTFSFF

SEQ ID NO: 1855 - protein, 68 aa, Homo Sapiens
  Brain
  SIGNAL -15..-1: Von Heijne matrix; score 4.10; seq APLELSCWGGGWG/LP
MAAPLELSCWGGGWGLPSVHSESLVVMAYAKFSGAPLKVNVIDNTWRGSRGDVPILTTEDDMVSQPAR

SEQ ID NO: 1856 - protein, 69 aa, Homo Sapiens
  Brain
  SIGNAL -20..-1: Von Heijne matrix
  score 4.10
  seq LGFLNCYIAVARS/GG
  UNSURE -18: Xaa = Glu,Gly,Val
MSXVGIDLGFLNCYIAVARSGGIETIANEYSDRCTPACISLGSRTRAIGNAAKSQIVTNVRNTIHGFKK

SEQ ID NO: 1857 - protein, 43 aa, Homo Sapiens
  Brain
  SIGNAL -19..-1: Von Heijne matrix
  score 4.10
  seq FVVFSTMFTASSP/GE
  UNSURE 12: Xaa =  * ,Cys,Phe,Leu,Ser,Trp,Tyr
  UNSURE -14: Xaa =  * ,Ser,Tyr
  UNSURE 24: Xaa = Arg,Trp
MEYSKXFVVFSTMFTASSPGEDFPPFFSQMXRLSRNYFPCPPX

SEQ ID NO: 1858 - protein, 72 aa, Homo Sapiens
  Brain
  SIGNAL -40..-1: Von Heijne matrix
  score 4.10
  seq LPFRLPWASTATA/RC
  UNSURE 11: Xaa = His,Leu,Pro,Arg
MPMASSPPPSPHPQEPAPLLPSLPRLSLPFRLPWASTATARCPPSPLGSLXLMLCIPTGFTPTQPRAPRPPG

SEQ ID NO: 1859 - protein, 55 aa, Homo Sapiens
  Brain
  SIGNAL -38..-1: Von Heijne matrix
  score 4.00
  seq WALGLKFLSSSSQ/NF
  UNSURE -31: Xaa = Asp,Glu,Val
  UNSURE -34: Xaa = Ser,Thr
MQHVXGHXPDPIAIMYVCPPCGHTTWALGLKFLSSSSQNFCAPVLFLILHTGGQR

SEQ ID NO: 1860 - protein, 53 aa, Homo Sapiens [sequence omitted]

SEQ ID NO: 1861 - protein, 38 aa, Homo Sapiens
  Brain
  SIGNAL -36..-1: Von Heijne matrix; score 4.00; seq VQLSFAATTPVLA/DK
MVFGGVCPSVTSIIAESLQGWNLVQLSFAATTPVLADK

SEQ ID NO: 1862 - protein, 24 aa, Homo Sapiens
  Brain
  SIGNAL -16..-1: Von Heijne matrix; score 4.00; seq ITWSLLFLYQCSL/HF
MHFITWSLLFLYQCSLHFIIIKAG

SEQ ID NO: 1863 - protein, 41 aa, Homo Sapiens
  Brain
  SIGNAL -36..-1: Von Heijne matrix; score 3.90; seq CWPSVASPSSSWS/SP
MSGASPIERTPMEEAPSSCPTSSCWPSVASPSSSWSSPWAS

SEQ ID NO: 1864 - protein, 50 aa, Homo Sapiens
  Brain
  SIGNAL -37..-1: Von Heijne matrix; score 3.90; seq PGPSLRLFSGSQA/SV
MEWAGKQRDFQVRAAPGWDHLASFPGPSLRLFSGSQASVCSLCSGFGAQE

SEQ ID NO: 1865 - protein, 67 aa, Homo Sapiens
  Brain
  SIGNAL -60..-1: Von Heijne matrix
  score 3.90
  seq AKVVSLSLQTSSA/HH
  UNSURE 6: Xaa = His,Ile,Leu,Asn,Arg,Ser
MIAFFDEDNPRKRRSYSFTQSAGILCQETTYSTPHTKLEKAKSPTADAKVVSLSLQTSSAHHRGGXG

SEQ ID NO: 1866 - protein, 87 aa, Homo Sapiens
  Brain
  SIGNAL -48..-1: Von Heijne matrix
  score 3.90
  seq ALFCTLPCPVERG/QQ
  UNSURE 6: Xaa = Ile,Lys,Met,Asn,Arg,Ser,Thr
  UNSURE -43: Xaa = Ile,Thr
  UNSURE -37: Xaa = Leu,Arg
  UNSURE -29: Xaa = Lys,Gln
  UNSURE 8: Xaa = Lys,Met,Thr
  UNSURE 7: Xaa = any one of the twenty amino acids
MGKSIXSLCSVXLKARLKGXLEAVHLCLRAQKRRTALFCTLPCPVERGQQVPGXXXRLRLASPSVAKVFQCFLSKLCVWNIKDGLSR

SEQ ID NO: 1867 - protein, 53 aa, Homo Sapiens
  Brain
  SIGNAL -15..-1: Von Heijne matrix
  score 3.90
  seq LHMTLFRVPFTFS/XF
  UNSURE 1: Xaa = Phe,Val
MCLHMTLFRVPFTFSXFWKGAGRQEECSFKPSLYYYKLIMVLKIALLLSPPPK

SEQ ID NO: 1868 - protein, 23 aa, Homo Sapiens [sequence omitted]

SEQ ID NO: 1869 - protein, 51 aa, Homo Sapiens
  Brain
  SIGNAL -40..-1: Von Heijne matrix; score 3.90; seq SPLLCLYHPPVYT/ST
MRARVWPRSHGIPVPSFLSKSSLSHTPSPLLCLYHPPVYTSTTTPSIPPRL

SEQ ID NO: 1870 - protein, 51 aa, Homo Sapiens
  Brain
  SIGNAL -36..-1: Von Heijne matrix
  score 3.90
  seq SLCLSLLIPGPKP/LV
  UNSURE -20: Xaa = His,Leu,Gln,Arg
MWNAVAIICNGSWCQTXSTSGLESLCLSLLIPGPKPLVSVGINQLLLTSSR

SEQ ID NO: 1871 - protein, 23 aa, Homo Sapiens
  Brain
  SIGNAL -14..-1: Von Heijne matrix
  score 3.90
  seq LRLGLFKISWARC/LS
  UNSURE 8: Xaa = Leu,Pro,Arg
MLRLGLFKISWARCLSYSKTQXE

SEQ ID NO: 1872 - protein, 61 aa, Homo Sapiens
  Brain
  SIGNAL -36..-1: Von Heijne matrix; score 3.90; seq VVEILPYLPCLTA/RD
MPFAEDKTYKYICRNFSNFCNVDVVEILPYLPCLTARDQDRLRATCTLSGNRDTLWHLFNT

SEQ ID NO: 1873 - protein, 40 aa, Homo Sapiens [sequence omitted]

SEQ ID NO: 1874 - protein, 66 aa, Homo Sapiens
  Brain
  SIGNAL -57..-1: Von Heijne matrix
  score 3.80
  seq QLXLVMEFCGAGS/VT
  UNSURE -11: Xaa =  * ,Trp
MDVTGDEEEEIKQEINMLKKYSHHRNIATYYGAFIKKNPPGMDDQLXLVMEFCGAGSVTDLIKNTG

SEQ ID NO: 1875 - protein, 26 aa, Homo Sapiens
  Brain
  SIGNAL -24..-1: Von Heijne matrix; score 3.80; seq KLFLVFLLNICKG/IV
MIFGLYFVLAVKLFLVFLLNICKGIV

SEQ ID NO: 1876 - protein, 46 aa, Homo Sapiens [sequence omitted]

SEQ ID NO: 1877 - protein, 57 aa, Homo Sapiens
  Brain
  SIGNAL -28..-1: Von Heijne matrix
  score 3.60
  seq ACLFSXFLAVSRH/PN
  UNSURE 4: Xaa =  * ,Ala,Cys,Asp,Glu,Gly,His,Lys,Asn,Pro,Gln,Arg,Ser,Thr,Trp,Tyr
  UNSURE -8: Xaa = Leu,Val
MPSSSLAELCLMQQDACLFSXFLAVSRHPNYXCSISTKGEVREKLVPWITHQMARML

SEQ ID NO: 1878 - protein, 46 aa, Homo Sapiens
  Brain
  SIGNAL -40..-1: Von Heijne matrix; score 3.60; seq LQMRMQLPCLVLG/EE
MDLWSCLFPVMLMEPSKGLEDSEWKMALQMRMQLPCLVLGEEQTLG

SEQ ID NO: 1879 - protein, 37 aa, Homo Sapiens
  Brain
  SIGNAL -27..-1: Von Heijne matrix; score 3.60; seq AVPLPTTSTLTSA/ST
MSGKGKCRPIALRRAVPLPTTSTLTSASTGFLWILKE

SEQ ID NO: 1880 - protein, 26 aa, Homo Sapiens [sequence omitted]

SEQ ID NO: 1881 - protein, 103 aa, Homo Sapiens
  Brain
  SIGNAL -72..-1: Von Heijne matrix; score 3.60; seq CTSLLQLYDASNS/EW
MPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAG

SEQ ID NO: 1882 - protein, 19 aa, Homo Sapiens
  Brain
  SIGNAL -15..-1: Von Heijne matrix; score 3.60; seq LVSFFLELNVLQQ/WP
MCLVSFFLELNVLQQWPAG

SEQ ID NO: 1883 - protein, 44 aa, Homo Sapiens [sequence omitted]

SEQ ID NO: 1884 - protein, 82 aa, Homo Sapiens
  Brain
  SIGNAL -13..-1: Von Heijne matrix; score 3.50; seq MHLLSNWANPASS/RR
MHLLSNWANPASSRRPSMAASGTSWISSTLAHSLSLRDVSERLCSCWRTISMGPCARGSPMNSSGVHRKSSRLFYIRTPMRR

SEQ ID NO: 1885 - protein, 118 aa, Homo Sapiens
  Brain
  SIGNAL -24..-1: Von Heijne matrix
  score 3.50
  seq FAMLHSVWRLIPA/FR
  UNSURE 92: Xaa =  * ,Gly,Arg
  UNSURE 84: Xaa = Phe,Ser
MWSGKWALVSPFAMLHSVWRLIPAFRGYAQQDAQEFLCELLDKIQRELETTGTSLPALIPTSQRKLIKQVLNVVNNIFHGQLLSQVTCLACDNKSNTIEPFWDLSLEXPERYQCSXKG

SEQ ID NO: 1886 - protein, 41 aa, Homo Sapiens
  Brain
  SIGNAL -20..-1: Von Heijne matrix; score 3.50; seq KFCLICLLTFIFH/HC
MKVHMHTKFCLICLLTFIFHHCNHCHEEHDHGPEALHRQQG

SEQ ID NO: 1887 - protein, 49 aa, Homo Sapiens
  Brain
  SIGNAL -24..-1: Von Heijne matrix; score 3.50; seq ALSLFYTADTSHG/SE
MGRRHWVLTHSALSLFYTADTSHGSEKPYLSLFGREGGREGSNPKYYSF

SEQ ID NO: 1888 - protein, 93 aa, Homo Sapiens
  Brain
  SIGNAL -16..-1: Von Heijne matrix
  score 12.50
  seq FVVLLALVAGVLG/NE
  UNSURE 75: Xaa =  * ,Cys,Gly,Arg,Ser,Trp
  UNSURE 77: Xaa = Gly,Arg,Trp
  UNSURE 70: Xaa = Ser,Tyr
MAVFVVLLALVAGVLGNEFSILKSPGSVVFRNGNWPIPGERIPDVAALSMGFSVKEDLSWPGLAVGNLFHRPRASVMVMVKGVNNXPLPPXWX

SEQ ID NO: 1889 - protein, 65 aa, Homo Sapiens
  Brain
  SIGNAL -16..-1: Von Heijne matrix; score 10.10; seq LLLQLAVLGAALA/AA
MAPLLLQLAVLGAALAAAALVLISIVAFTTATKMPALHRHEEEKFFLNAKGQKETLPSIWDSPTR

SEQ ID NO: 1890 - protein, 84 aa, Homo Sapiens
  Brain
  SIGNAL -50..-1: Von Heijne matrix; score 9.80; seq LLRLLQLVSTCVA/FS
MPVTVTRTTITTTTTSSSGLGSPMIVGSPRALTQPLGLLRLLQLVSTCVAFSLVASVGAWTGSMGNWSMFTWCFCFSVTLIILI

SEQ ID NO: 1891 - protein, 72 aa, Homo Sapiens
  Brain
  SIGNAL -18..-1: Von Heijne matrix; score 9.20; seq VFLCSLLAPMVLA/SA
MELVLVFLCSLLAPMVLASAAEKEKEMDPFHYDYQTLRIGGLVFAVVLFSVGILLILSRRCKCSFNQKPRNR

SEQ ID NO: 1892 - protein, 70 aa, Homo Sapiens
  Brain
  SIGNAL -46..-1: Von Heijne matrix; score 7.90; seq LLGLLSAEQLAEA/SV
MGPIWSSYYGNCRSLLFVMDASDPTQLSASCVQLLGLLSAEQLAEASVLILFNKIDLPCYMSTEEMKSLI

SEQ ID NO: 1893 - protein, 57 aa, Homo Sapiens
  Brain
  SIGNAL -47..-1: Von Heijne matrix; score 7.90; seq LLLPRVLLTMASG/SP
MSGGRAPAVLLGGVASLLLSFVWMPALLPVASRLLLLPRVLLTMASGSPPTQPSPAW

SEQ ID NO: 1894 - protein, 92 aa, Homo Sapiens
  Brain
  SIGNAL -40..-1: Von Heijne matrix
  score 7.90
  seq SLLLLFGGQFASS/QE
  UNSURE -14: Xaa = Glu,Gly,Lys,Arg
MALSCTLNRYLLLMAQEHLEFRLPEIXSLLLLFGGQFASSQETYGKSPFWILSIPSEDIARNLMKRTVCAKSIFELWGHGQSPEELYSSLKN

SEQ ID NO: 1895 - protein, 91 aa, Homo Sapiens
  Brain
  SIGNAL -53..-1: Von Heijne matrix; score 7.10; seq IAVGLGVAALAFA/GR
MAARGVIAPVGESLRYAEYLQPSAKRPDADVDQQRLVRSLIAVGLGVAALAFAGRYAFRIWKPLEQVITETAKKISTPSFSSYYKGGFERR

SEQ ID NO: 1896 - protein, 31 aa, Homo Sapiens
  Brain
  SIGNAL -28..-1: Von Heijne matrix
  score 6.60
  seq VLGXLFLGGLCRG/WD
  UNSURE -10: Xaa = Glu,Val
MRMCAGSIYKSATQAVLGXLFLGGLCRGWDA

SEQ ID NO: 1897 - protein, 80 aa, Homo Sapiens
  Brain
  SIGNAL -78..-1: Von Heijne matrix
  score 6.30
  seq TLIMLLSWQLSVS/SV
  UNSURE -65: Xaa = Ala,Cys,Asp,Phe,Gly,His,Ile,Leu,Asn,Pro,Arg,Ser,Thr,Val,Tyr
  UNSURE -49: Xaa = Ala,Pro
MAERRRPLSPIPSXRRPSEPSRPRPAAAGXRSLPRPGDEELQLPCAVHDLIFWRDVKKTGFVFGTTLIMLLSWQLSVSSV

SEQ ID NO: 1898 - protein, 133 aa, Homo Sapiens
  Brain
  SIGNAL -109..-1: Von Heijne matrix; score 6.00; seq LQLLLGMTASAVA/AL
MAAPVLLRVSVPRWERVARYAVCAAGILLSIYAYHVEREKERDPEHRALCDLGPWVKCSAALASRWGRGFGLLGSIFGKDGVLNQPNSVFGLIFYILQLLLGMTASAVAALILMTSSIMSVVGSCTWPTFCTT

SEQ ID NO: 1899 - protein, 106 aa, Homo Sapiens
  Brain
  SIGNAL -34..-1: Von Heijne matrix
  score 5.90
  seq LGAAALALLLANT/DV
  UNSURE 8: Xaa = His,Leu,Gln
MSFLQDPSFFTMGMWSIGAGALGAAALALLLANTDVFLSKPXKAALEYLEDIDLKTLEKEPRTFKAKELWEKNGAVIMAVRRPGCFLCREEAADLSSLKSMLDQLG

SEQ ID NO: 1900 - protein, 56 aa, Homo Sapiens
  Brain
  SIGNAL -37..-1: Von Heijne matrix; score 4.90; seq MLIMLGIFFNVHS/AV
MASLLCCGPKLAACGIVLSAWGVIMLIMLGIFFNVHSAVLIEDVPFTEKDFENGPR

SEQ ID NO: 1901 - protein, 32 aa, Homo Sapiens
  Brain
  SIGNAL -20..-1: Von Heijne matrix
  score 4.90
  seq XSLFLHAVSSSFT/QL
  UNSURE -13: Xaa = Leu,Arg
MILPYRMXSLFLHAVSSSFTQLRSCQGDRVWR

SEQ ID NO: 1902 - protein, 78 aa, Homo Sapiens
  Brain
  SIGNAL -63..-1: Von Heijne matrix
  score 4.80
  seq LYTVRALAGRAWA/AV
  UNSURE 7: Xaa = Ala,Pro
MATLVELPDSVLLEIFSYLPVRDRIRISRVCHRWKRLVDDRWLWRHVDLTLYTVRALAGRAWAAVAVPGXRRPPLPPW

SEQ ID NO: 1903 - protein, 92 aa, Homo Sapiens
  Brain
  SIGNAL -41..-1: Von Heijne matrix
  score 4.70
  seq LFSCFCFLSHKFG/KK
  UNSURE 44: Xaa = Pro,Thr
MKNACIVLPPTPPPSLQPSASLLAPNRFLFSCFCFLSHKFGKKVIYFNYLSELHEHLKYDQLVIPPEVLRYDEKLQSLHEGRTPXPTKTPPG

SEQ ID NO: 1904 - protein, 55 aa, Homo Sapiens
  Brain
  SIGNAL -28..-1: Von Heijne matrix
  score 4.60
  seq PLQWSLLVAVVAG/SV
  UNSURE 11: Xaa = Glu,Lys
MAFGLQMFIQRKFPYPLQWSLLVAVVAGSVVSYGVTRVXSEKCNNLWLFLETGLG

SEQ ID NO: 1905 - protein, 69 aa, Homo Sapiens
  Brain
  SIGNAL -53..-1: Von Heijne matrix; score 4.50; seq LLWTPLLSPGSLR/VI
MYCKILVLMLHTELIRTDYSSVDQLLLNYPAEEGLGRERSLLWTPLLSPGSLRVILESREVPVSLWPQT

SEQ ID NO: 1906 - protein, 86 aa, Homo Sapiens
  Brain
  SIGNAL -26..-1: Von Heijne matrix
  score 4.50
  seq ENSLIILLQGLQG/RV
  UNSURE 19: Xaa = Lys,Asn
MAVSHSVKERTISENSLIILLQGLQGRVTTVDLRDESVAHGRIDXVDAFMNIRLAKVTYTDRWGHQVKLDDLFVTGRNVRYVHIPD

SEQ ID NO: 1907 - protein, 91 aa, Homo Sapiens
  Brain
  SIGNAL -23..-1: Von Heijne matrix
  score 4.40
  seq QFILLGTTSVVTA/AL
  UNSURE 65: Xaa = Lys,Asn
MESGGRPSLCQFILLGTTSVVTAALYSVYRQKARVSQELKGAKKVHLGEDLKSILSEAPGKCVPYAVIEGAVRSVKETLNSQFVENCXGVR

SEQ ID NO: 1908 - protein, 142 aa, Homo Sapiens
  Brain
  SIGNAL -139..-1: Von Heijne matrix
  score 4.30
  seq GILVPHSLRQAQA/SF
  UNSURE -62: Xaa = Ala,Cys,Gly,Ser,Thr
  UNSURE -131,-120: Xaa = Asp,Glu
  UNSURE -66: Xaa = Asp,Gly,Val
  UNSURE -118: Xaa = Glu,Gly
  UNSURE -65: Xaa = Pro,Ser
MAALDLRAXWIRWSCSCLGXLXGAGGETNGVERPGGGGLALARQGSLRDGRQVGRAPAVCFPHGAPGLPPRQRXXGGXPEVQGGESWCPRPRGGGASRTGLRRRKGPTKTPEPESSEAPQDPLNWFGILVPHSLRQAQASFR

SEQ ID NO: 1909 - protein, 29 aa, Homo Sapiens
  Brain
  SIGNAL -21..-1: Von Heijne matrix; score 4.10; seq WWISLLPSLLSIC/KV
MAFLPSPAWWISLLPSLLSICKVLMPKLK

SEQ ID NO: 1910 - protein, 127 aa, Homo Sapiens
  Brain
  SIGNAL -49..-1: Von Heijne matrix
  score 3.80
  seq PAFHLPLPGPTLA/FL
  UNSURE 56: Xaa =  * ,Lys,Pro,Gln,Ser,Thr
  UNSURE 55: Xaa = Glu,Gly
MEPKVAELKQKIEDTLCPFGFEVYPFQVAWYNELLPPAFHLPLPGPTLAFLVLSTPAMFDRALKPFLQSCHLRMLTDPVDQCVAYHLGRVRESLPELQIEIIAXXRGAPQPTPQDPGPDSSHVAGAA

SEQ ID NO: 1911 - protein, 98 aa, Homo Sapiens
  Brain
  SIGNAL -13..-1: Von Heijne matrix; score 3.70; seq MLVLRSGLTKALA/SR
MLVLRSGLTKALASRTLAPQVCSSFATGPRQYDGTFYEFRTYYLKPSNMNAFMENLKKNIHLRTSYSELVGFWSVEFGGRTNKVFHIWKYDNFAHRAE

SEQ ID NO: 1912 - protein, 27 aa, Homo Sapiens
  Brain
  SIGNAL -23..-1: Von Heijne matrix; score 10.50; seq LLFVLLLFSLLPA/CL
MSGGHLADLTLLFVLLLFSLLPACLPR

SEQ ID NO: 1913 - protein, 54 aa, Homo Sapiens
  Brain
  SIGNAL -51..-1: Von Heijne matrix; score 10.10; seq LLGALTLLGLVTS/FY
MKPSRTPARLWMLPQQQAGAVVVAAPTERHPTHHMAGWLLGALTLLGLVTSFYK

SEQ ID NO: 1914 - protein, 131 aa, Homo Sapiens
  Brain
  SIGNAL -64..-1: Von Heijne matrix
  score 9.50
  seq LSLLAALAHLAAA/EK
  UNSURE 47: Xaa =  * ,Cys,Asp,Glu,Phe,Gly,Ile,Lys,Leu,Met,Asn,Arg,Ser,Val,Trp,Tyr
  UNSURE 48: Xaa =  * ,Cys,Phe,Leu,Ser,Trp,Tyr
MGESIPLAAPVPVEQAVLETFFSHLGIFSYDKAKDNVEKEREANKSAGGSWLSLLAALAHLAAAEKVYHSLTYLGQKLGGQSFFSRKDSIRTIYTSLHNELKKVVTGRGAXXWDCSSRGRTPFPPVRAAYG

SEQ ID NO: 1915 - protein, 86 aa, Homo Sapiens
  Brain
  SIGNAL -38..-1: Von Heijne matrix; score 9.30; seq QLLYLSLLSGLHG/QE
MQMSYAIRCAFYQLLLAALMLVAMLQLLYLSLLSGLHGQEEQDQYFEFFPPSPRSVDQVKAQLRTALASGGVLDASGDYRVYRGHG

SEQ ID NO: 1916 - protein, 26 aa, Homo Sapiens
  Brain
  SIGNAL -24..-1: Von Heijne matrix; score 9.10; seq LFAFHLLLSFILG/SR
MLRAELKIAVVLFAFHLLLSFILGSR

SEQ ID NO: 1917 - protein, 76 aa, Homo Sapiens
  Brain
  SIGNAL -55..-1: Von Heijne matrix; score 9.00; seq LLILLLRTFLCSA/MI
MNHQQTLIGRLLCDLHGLSLSPPVANNVQALFRMLTPEAYSCLLILLLRTFLCSAMIANTLHLKYHLQLIDNACPE

SEQ ID NO: 1918 - protein, 84 aa, Homo Sapiens
  Brain
  SIGNAL -40..-1: Von Heijne matrix; score 8.60; seq LFCVLGIVLLVTG/IV
MIITAVVSISVTIFCFQTKVDFTSCTGLFCVLGIVLLVTGIVTSIVLYFQYVYWLHMLYAALGAICFTLFLAYDTQLVLGNRKH

SEQ ID NO: 1919 - protein, 89 aa, Homo Sapiens
  Brain
  SIGNAL -65..-1: Von Heijne matrix
  score 8.40
  seq LLWFIHLVFVVLX/LF
  UNSURE 9: Xaa =  * ,Leu
  UNSURE -1: Xaa = Ala,Gly
  UNSURE 16: Xaa = Lys,Arg
MAAGGRMEDGSLDITQSIEDDPLLDAQLLPHHSLQAHFRPRFHPLPTVIIVNLLWFIHLVFVVLXLFNRCALFXSYPKWDXCPGNYTNP

SEQ ID NO: 1920 - protein, 59 aa, Homo Sapiens
  Brain
  SIGNAL -16..-1: Von Heijne matrix; score 7.50; seq GCMLLFVFGFVGG/AV
MSPGCMLLFVFGFVGGAVVINSAILVSLSVLLLVHFSISTGVPALTQNLPRILRKERPG

SEQ ID NO: 1921 - protein, 67 aa, Homo Sapiens
  Brain
  SIGNAL -15..-1: Von Heijne matrix
  score 7.50
  seq LLLGIALLAYVAS/VW
  UNSURE 38: Xaa = Glu,Gly
MKLLLGIALLAYVASVWGNFVNMRSIQENGELKIESKIEEMVEPLREKIRDLXKSFTQKYPPVKFLS

SEQ ID NO: 1922 - protein, 151 aa, Homo Sapiens
  Brain
  SIGNAL -23..-1: Von Heijne matrix
  score 7.50
  seq LVLLLTLPLHLMA/LL
  UNSURE 109: Xaa = Lys,Gln
MDILVPLLQLLVLLLTLPLHLMALLGCWQPLCKSYFPYLMAVLTPKSNRKMESKKRELFSQIKGLTGASGKVALLELGCGTGANFQFYPPGCRVTCLDPNPHFEKFLTKSMAENRHLQYERFVVAPGEDMRXLADGSMDVVVCTLVLCSVQ

SEQ ID NO: 1923 - protein, 103 aa, Homo Sapiens
  Brain
  SIGNAL -35..-1: Von Heijne matrix
  score 7.40
  seq SLLLSLELASGSG/QG
  UNSURE -21: Xaa = Ser,Thr
MEAASPSNSTGVERXADLMDADSLLLSLELASGSGQGLSPDRRASLLTSLMLVKRDYRYDRVLFWGRILGLVADYYIAQGLSEDQLAPRKTLYRSRSRKRPAL

SEQ ID NO: 1924 - protein, 70 aa, Homo Sapiens
  Brain
  SIGNAL -43..-1: Von Heijne matrix; score 7.40; seq VLVKLLSSSASTS/RP
MIRQERSTSYQEAVRPALPSSKPCLLTSPAVLVKLLSSSASTSRPPDLGHLWQPSSSVPLHRPPHTAPPA

SEQ ID NO: 1925 - protein, 113 aa, Homo Sapiens
  Brain
  SIGNAL -41..-1: Von Heijne matrix
  score 7.40
  seq ILPLLFGCLGVFG/LF
  UNSURE 39: Xaa = Ala,Glu,Lys,Thr
  UNSURE 48: Xaa = Pro,Thr
MKLIDYGLSGYQEESAEVKAMDFITSTAILPLLFGCLGVFGLFRLLQWVRGKAYLRNAVVVITGATSGLGKECAKVFYAXGAKLVLCEXEWWGLEELIRELTASHATKVQTHK

SEQ ID NO: 1926 - protein, 44 aa, Homo Sapiens
  Brain
  SIGNAL -19..-1: Von Heijne matrix; score 7.40; seq PMLLRALAQAARA/GP
MRCLTTPMLLRALAQAARAGPPGGRSLHSSAVAATYKYVNMQDQ

SEQ ID NO: 1927 - protein, 84 aa, Homo Sapiens
  Brain
  SIGNAL -67..-1: Von Heijne matrix; score 7.00; seq IWTLLSSVIRCLC/AI
MSRFLNVLRSWLVMVSIIAMGNTLQSFRDHTFLYEKLYTGKPNLVNGLQARTFGIWTLLSSVIRCLCAIDIHNKTLYHITLWTF

SEQ ID NO: 1928 - protein, 29 aa, Homo Sapiens
  Brain
  SIGNAL -14..-1: Von Heijne matrix
  score 6.80
  seq IFLTLSLDSRVSA/IR
  UNSURE 13: Xaa = Ala,Asp,Asn,Ser,Thr,Tyr
MIFLTLSLDSRVSAIRSPNFVYRSPTXHG

SEQ ID NO: 1929 - protein, 101 aa, Homo Sapiens
  Brain
  SIGNAL -29..-1: Von Heijne matrix
  score 6.80
  seq LIFLCGAALLXVG/IW
  UNSURE 54: Xaa =  * ,Lys
  UNSURE -3: Xaa = Ala,Thr
  UNSURE 62: Xaa = Cys,Phe
  UNSURE 48: Xaa = Gly,Arg
MQCFSFIKTMMILFNLLIFLCGAALLXVGIWVSIDGASFLKIFGPLSSSAMQFVNVGYFLIAAGVVVFALGFLGCYXAKTESXCALVTFFXILLLIFIADV

SEQ ID NO: 1930 - protein, 97 aa, Homo Sapiens
  Brain
  SIGNAL -35..-1: Von Heijne matrix
  score 6.40
  seq SACLLLCPTWTNP/QL
  UNSURE -25: Xaa = Arg,Thr
  UNSURE 31: Xaa = Cys,Phe,Gly,Ile,Leu,Met,Arg,Ser,Val,Trp
  UNSURE 61: Xaa = Gly,Arg,Trp
  UNSURE 30: Xaa = Ile,Asn,Ser,Thr
MAEAALEAVRXSYENSRPLQGSSACLLLCPTWTNPQLRSTSTGTGSAPTGRALSATLCSTGRPSXXWSLPYFRATVGSTEVSVAVTPDGYADAVRXD

SEQ ID NO: 1931 - protein, 34 aa, Homo Sapiens
  Brain
  SIGNAL -19..-1: Von Heijne matrix; score 6.40; seq SVFLLMVNGQVES/AQ
MATASPSVFLLMVNGQVESAQFPEYDDLYCKYCQ

SEQ ID NO: 1932 - protein, 36 aa, Homo Sapiens
  Brain
  SIGNAL -28..-1: Von Heijne matrix; score 6.00; seq IGLMFLMLGCALP/IY
MAGIKALISLSFGGAIGLMFLMLGCALPIYNKYWPW

SEQ ID NO: 1933 - protein, 39 aa, Homo Sapiens
  Brain
  SIGNAL -17..-1: Von Heijne matrix; score 5.90; seq ILLFGTLLMNAGA/VL
MIGDILLFGTLLMNAGAVLNFKLKKKDTQGFGEESREPW

SEQ ID NO: 1934 - protein, 28 aa, Homo Sapiens
  Brain
  SIGNAL -16..-1: Von Heijne matrix; score 5.90; seq MILTLSLFGSCIS/NF
MKTMILTLSLFGSCISNFERYMTERSIQ

SEQ ID NO: 1935 - protein, 82 aa, Homo Sapiens
  Brain
  SIGNAL -39..-1: Von Heijne matrix
  score 5.90
  seq SVSVLSSLGIVLA/VV
  UNSURE -31: Xaa =  * ,Trp
  UNSURE -16: Xaa = Ala,Cys,Asp,Phe,Gly,His,Ile,Leu,Asn,Pro,Arg,Ser,Thr,Val,Tyr
  UNSURE -30: Xaa = Ala,Pro
  UNSURE -17: Xaa = Asp,Glu
  UNSURE 33: Xaa = Leu,Met
MDWRVPPSXXDPGHQDIPLPVTXXFISVSVLSSLGIVLAVVCLSFNIYNSHVRYIQNSQPNLNNLTAVGCSXALAAVFPWGS

SEQ ID NO: 1936 - protein, 113 aa, Homo Sapiens
  Brain
  SIGNAL -16..-1: Von Heijne matrix
  score 5.80
  seq AALPAWLSLQSRA/RT
  UNSURE 18: Xaa = Arg,Thr
  UNSURE 82: Xaa = Glu,Gln
  UNSURE 52: Xaa = Ile,Ser
  UNSURE 87: Xaa = Met,Arg
MAAAALPAWLSLQSRARTLRAFSTAVYSATPVPXPSLPERTPGNERPPRRKALPPRTEKMAVDQDWPXVYPVAAPFKPSAVPLPVRMGYPVKKGVPWXRRESXTFKDSNFLHL

SEQ ID NO: 1937 - protein, 29 aa, Homo Sapiens
  Brain
  SIGNAL -25..-1: Von Heijne matrix; score 5.80; seq LWISACAMLLCHG/SL
MAMVSAMSWVLYLWISACAMLLCHGSLQR

SEQ ID NO: 1938 - protein, 78 aa, Homo Sapiens [sequence omitted]

SEQ ID NO: 1939 - protein, 65 aa, Homo Sapiens
  Brain
  SIGNAL -21..-1: Von Heijne matrix; score 5.60; seq LVLSLQFLLLSYD/LF
MLQTSNYSLVLSLQFLLLSYDLFVNSFSELLQKTPVIQLVLFIIQDIAVLFNIIIIFLMFFNTSR

SEQ ID NO: 1940 - protein, 27 aa, Homo Sapiens
  Brain
  SIGNAL -24..-1: Von Heijne matrix; score 5.50; seq MGVCLLIPGLATA/CI
MWFEILPGLSVMGVCLLIPGLATACIR

SEQ ID NO: 1941 - protein, 46 aa, Homo Sapiens
  Brain
  SIGNAL -22..-1: Von Heijne matrix
  score 5.50
  seq LADPLXLFPFSEG/LP
  UNSURE -8: Xaa = Cys,Phe
MRPSPLSGILADPLXLFPFSEGLPRRRAASRSRLQTPSARCSPRPG

SEQ ID NO: 1942 - protein, 30 aa, Homo Sapiens
  Brain
  SIGNAL -27..-1: Von Heijne matrix
  score 5.40
  seq SLMMAQXFIPAVA/KV
  UNSURE -21: Xaa = Cys,Phe,Gly,Ile,Leu,Met,Arg,Ser,Val,Trp
  UNSURE -7: Xaa = Gly,Val
MRESLSXRSWHLPASLMMAQXFIPAVAKVG

SEQ ID NO: 1943 - protein, 60 aa, Homo Sapiens
  Brain
  SIGNAL -58..-1: Von Heijne matrix
  score 5.40
  seq LSLHLLATRACYG/IL
  UNSURE -22: Xaa = Ala,Gly,Leu,Met,Arg,Ser,Thr,Val,Trp
  UNSURE -45: Xaa = Cys,Gly,Arg,Ser
MSGVVPTAPEQPAXEMENQTKPPDPRPDAPPEYSSHXFTRTPWKQLSLHLLATRACYGIL

SEQ ID NO: 1944 - protein, 83 aa, Homo Sapiens
  Brain
  SIGNAL -77..-1: Von Heijne matrix
  score 5.30
  seq TWVFTCLVFFCFG/LS
  UNSURE 3: Xaa = Pro,Thr
MWRYQFGWGVITRGPREIPFPPSLLASESLLPPLPDLVLTCTSLGFVTRVWMSLNLNELSLYSRTWVFTCLVFFCFGLSXSLG

SEQ ID NO: 1945 - protein, 39 aa, Homo Sapiens
  Brain
  SIGNAL -29..-1: Von Heijne matrix; score 5.20; seq FFMLLGSLLPVKI/IE
MVKLLVAKILCMVGVFFFMLLGSLLPVKIIETDFEKAPG

SEQ ID NO: 1946 - protein, 22 aa, Homo Sapiens
  Brain
  SIGNAL -17..-1: Von Heijne matrix; score 5.20; seq IMCLIGLKANASS/ET
MPVSIMCLIGLKANASSETHSG

SEQ ID NO: 1947 - protein, 26 aa, Homo Sapiens [sequence omitted]

SEQ ID NO: 1948 - protein, 46 aa, Homo Sapiens
  Brain
  SIGNAL -19..-1: Von Heijne matrix
  score 5.10
  seq LLLGGRVCXPSLA/VG
  UNSURE -5: Xaa = Ala,Pro
MAVTLSLLLGGRVCXPSLAVGSRPGGWRAQALLAGSRTPIPTGNRR

SEQ ID NO: 1949 - protein, 49 aa, Homo Sapiens
  Brain
  SIGNAL -23..-1: Von Heijne matrix; score 5.10; seq LLPELGVVTPAQG/PR
MLNQTSGRTSLLPELGVVTPAQGPRRRVWCGHSKAKARKSYCARAIDCQ

SEQ ID NO: 1950 - protein, 135 aa, Homo Sapiens
  Brain
  SIGNAL -79..-1: Von Heijne matrix; score 5.00; seq SFLGFSAPTPIQA/LT
MTSENLVQTAPKKKKNKGKKGLEPSQSTAAKVPKKAKTWIPEVHDQKADVSAWKDLFVPRPVLRALSFLGFSAPTPIQALTLAPAIRDKLDILGAAETGSGKTLAFAIPMIHAVLQWQKRNAAPPPSNTEAPPGE

SEQ ID NO: 1951 - protein, 79 aa, Homo Sapiens
  Brain
  SIGNAL -23..-1: Von Heijne matrix
  score 4.90
  seq WHXLIPLTWACMA/RQ
  UNSURE -16: Xaa = Ala,Pro
  UNSURE -14: Xaa = Asn,Ser
  UNSURE -11: Xaa = Leu,Arg
  UNSURE 17: Xaa = Leu,Trp
  UNSURE -15: Xaa = Phe,Leu
MAAFGRQXXXWHXLIPLTWACMARQTPHLGEQRRTTASLXRKLTTASNGGVIEELSCVRSNNYVQEPECRRNLVQCLLW

SEQ ID NO: 1952 - protein, 68 aa, Homo Sapiens
  Brain
  SIGNAL -57..-1: Von Heijne matrix; score 4.90; seq GWFLSGCPHGSSA/TW
MSLTSSPKKRRSICFDRFLMPQSQSGPSSLGESYRTGVGFLIPEGWFLSGCPHGSSATWTKCQTSASL

SEQ ID NO: 1953 - protein, 46 aa, Homo Sapiens
  Brain
  SIGNAL -39..-1: Von Heijne matrix
  score 4.80
  seq SLXFCLSPPPSPS/LR
  UNSURE -11: Xaa = Ala,Thr
MGELGNRSRCILFLSENPCLSESIFQSLXFCLSPPPSPSLRPSPSR

SEQ ID NO: 1954 - protein, 111 aa, Homo Sapiens
  Brain
  SIGNAL -93..-1: Von Heijne matrix
  score 4.70
  seq VLLLRQXFAQAEK/WY
  UNSURE -7: Xaa = Leu,Met,Val
MAELGLNEHHQNEVINYMRFARSKRGLRLKTVDSCFQDLKESRLVEDTFTIDEVSEVLNGLQAVVHSEVESELINTAYTNVLLLRQXFAQAEKWYLKLQTDISELENRELL

SEQ ID NO: 1955 - protein, 70 aa, Homo Sapiens
  Brain
  SIGNAL -49..-1: Von Heijne matrix
  score 4.60
  seq SWAVGLLYAVAQG/SK
  UNSURE 13: Xaa = Cys,Gly,Arg,Ser
MVTLPSGTWAFSCPYLALVDGGMLGSAREDAHASVVSWAVGLLYAVAQGSKRRKVQDVKPLXWSRTGTLG

SEQ ID NO: 1956 - protein, 80 aa, Homo Sapiens
  Brain
  SIGNAL -68..-1: Von Heijne matrix
  score 4.60
  seq LPFSLVSMLVTQG/LV
  UNSURE -38: Xaa =  * ,Ala,Glu,Gly,Ile,Lys,Leu,Pro,Gln,Arg,Ser,Thr,Val
  UNSURE -39: Xaa =  * ,Ser,Tyr
MASASARGNQDKDAHFPPPSKQSLLFCPKXXLHIHRAEISKIMRECQEESFWKRALPFSLVSMLVTQGLVYQGYLAANSR

SEQ ID NO: 1957 - protein, 71 aa, Homo Sapiens [sequence omitted]

SEQ ID NO: 1958 - protein, 50 aa, Homo Sapiens
  Brain
  SIGNAL -16..-1: Von Heijne matrix
  score 4.50
  seq RLLLRRFLASVIS/RK
  UNSURE 20: Xaa =  * ,Gln
  UNSURE 23: Xaa = Pro,Ser
MAQRLLLRRFLASVISRKPSQGQWPPLTSRALQTPXCSXGGLTVTPNPSR

SEQ ID NO: 1959 - protein, 103 aa, Homo Sapiens
  Brain
  SIGNAL -77..-1: Von Heijne matrix
  score 4.40
  seq FEARIALLPLLQA/ET
  UNSURE -65: Xaa = Pro,Thr
MAASKVKQDMPPXGGYGPIDYKRNLPRRGLSGYSMLAIGIGTLIYGHWSIMKWNRERRRLQIEDFEARIALLPLLQAETDRRTLQMLRENLEEEAIIMKDVPG

SEQ ID NO: 1960 - protein, 77 aa, Homo Sapiens
  Brain
  SIGNAL -54..-1: Von Heijne matrix
  score 4.30
  seq LLSLAILSHISTP/GC
  UNSURE 12: Xaa = Asp,His,Tyr
MRHLVTEELFPCSNLEDVVEDNSHSYFTLRITMACKGVPSTLLSLAILSHISTPGCEWHVIYVSSXGLYLVVEMTDR

SEQ ID NO: 1961 - protein, 80 aa, Homo Sapiens
  Brain
  SIGNAL -76..-1: Von Heijne matrix
  score 4.30
  seq FRLLXVFAYGTYA/DY
  UNSURE 3: Xaa =  * ,Leu
  UNSURE -18: Xaa = Asp,His,Asn,Tyr
  UNSURE -9: Xaa = Lys,Thr
MSAEVKVTGQNQEQFLLLAKSAKGAALATLIHQVLEAPGVYVFGELLDMPNVRELAESXFASTFRLLXVFAYGTYADYXA

SEQ ID NO: 1962 - protein, 45 aa, Homo Sapiens
  Brain
  SIGNAL -34..-1: Von Heijne matrix
  score 4.30
  seq QLFAFLNLLPVEA/DI
  UNSURE -19: Xaa =  * ,Tyr
  UNSURE 3: Xaa = Leu,Val
  UNSURE -15: Xaa = Ser,Thr
MLLSIGMLMLSATQVXTILXVQLFAFLNLLPVEADIXAYNFENAS

SEQ ID NO: 1963 - protein, 28 aa, Homo Sapiens [sequence omitted]

SEQ ID NO: 1964 - protein, 72 aa, Homo Sapiens
  Brain
  SIGNAL -32..-1: Von Heijne matrix
  score 4.20
  seq CWELFCLEHGIQA/DG
  UNSURE 34: Xaa = Cys,Ser
MRECISVHVGQAGVQIGNACWELFCLEHGIQADGTFDAQASKINDDDSFTTFFSETGTSLLMERLXLDYGKK

SEQ ID NO: 1965 - protein, 46 aa, Homo Sapiens
  Brain
  SIGNAL -25..-1: Von Heijne matrix; score 4.20; seq LDLLRGLPRVSLA/NL
MAGPLQGGGARALDLLRGLPRVSLANLKPNPGSKKPERRPRGRRRW

SEQ ID NO: 1966 - protein, 68 aa, Homo Sapiens
  Brain
  SIGNAL -25..-1: Von Heijne matrix
  score 4.20
  seq MFAASXLAMCAGA/EV
  UNSURE -8: Xaa = Ile,Leu
MPAGVPMSTYLKMFAASXLAMCAGAEVVHRYYRPDLTIPEIPPKRGELKTELLGLKERKHKPQVSQQE

SEQ ID NO: 1967 - protein, 82 aa, Homo Sapiens
  Brain
  SIGNAL -24..-1: Von Heijne matrix
  score 4.20
  seq SLPALALSLRASP/RX
  UNSURE 2: Xaa = Leu,Val
MAVQCVRLARRSLPALALSLRASPRXLCTATKQKNSGQNLEEDMGQSEQKADPPATEKTLLEEKVKLEEQLKETVEKYKRAR

SEQ ID NO: 1968 - protein, 42 aa, Homo Sapiens
  Brain
  SIGNAL -37..-1: Von Heijne matrix; score 4.20; seq RLMHHYLSTPTSA/RP
MFSIISRSRACSMYFKENAKPSQLRLMHHYLSTPTSARPHHL

SEQ ID NO: 1969 - protein, 35 aa, Homo Sapiens
  Brain
  SIGNAL -16..-1: Von Heijne matrix; score 4.10; seq LLPATSLAGPVLS/TL
MKRLLPATSLAGPVLSTLIAPTPMLFCEDKSWDPG

SEQ ID NO: 1970 - protein, 98 aa, Homo Sapiens
  Brain
  SIGNAL -70..-1: Von Heijne matrix
  score 4.00
  seq IAVLYLHLYDVFG/DP
  UNSURE -25: Xaa = Leu,Pro,Arg
  UNSURE -24: Xaa = Pro,Arg,Thr
MLIITNPWPKYFDAAGRLTPEFSQRLTNKIRELLQQMERGLKSADXXDGTGYTGWAGIAVLYLHLYDVFGDPAYLQLAHGYVKQSLNCLTKRSITFQG

SEQ ID NO: 1971 - protein, 47 aa, Homo Sapiens
  Brain
  SIGNAL -21..-1: Von Heijne matrix
  score 3.90
  seq AWLAQGSSSAGWG/LE
  UNSURE 25: Xaa = Ala,Pro,Ser
MCATETVRAWLAQGSSSAGWGLERKQGVSAHRMPALRWLQKSVPGXM

SEQ ID NO: 1972 - protein, 48 aa, Homo Sapiens
  Brain
  SIGNAL -46..-1: Von Heijne matrix
  score 3.90
  seq AAAFCLKXXGANT/HP
  UNSURE -28: Xaa = Cys,Tyr
  UNSURE -6: Xaa = Ile,Met
  UNSURE -5: Xaa = Ser,Thr
MLLLATHPETVGQVTLRVXPVSLEVSIQMCAAAAAAFCLKXXGANTHP

SEQ ID NO: 1973 - protein, 86 aa, Homo Sapiens
  Brain
  SIGNAL -64..-1: Von Heijne matrix
  score 3.90
  seq GLGGAQLQGGAXG/RG
  UNSURE -2: Xaa =  * ,Trp
  UNSURE -53: Xaa = Gly,Arg
  UNSURE -54: Xaa = Ser,Thr
MAASSATPAPXXSQRCGADAGSAARIVFRWGRGRRGARSPEGSGHHGRANSGLGGAQLQGGAXGRGSMAPLRASAGQTRDGPTQPG

SEQ ID NO: 1974 - protein, 50 aa, Homo Sapiens
  Brain
  SIGNAL -17..-1: Von Heijne matrix; score 3.90; seq PLAGLAAAALGRA/PP
MLRRPLAGLAAAALGRAPPDGLLCSLPGVAVEDPVQDSAGFSFSLMDRPK

SEQ ID NO: 1975 - protein, 53 aa, Homo Sapiens
  Brain
  SIGNAL -17..-1: Von Heijne matrix; score 3.80; seq GFVAALVAGGVAG/VS
MDRPGFVAALVAGGVAGVSVDLILFPLDTIKTRLQSPQGFSKAGGFHGIYASW

SEQ ID NO: 1976 - protein, 50 aa, Homo Sapiens [sequence omitted]

SEQ ID NO: 1977 - protein, 50 aa, Homo Sapiens
  Brain
  SIGNAL -20..-1: Von Heijne matrix; score 3.80; seq ALDALMFPARRRA/AV
MRTFVHFALDALMFPARRRAAVTRLSERLSLCFCLHSRLQDPAARPRPSW

SEQ ID NO: 1978 - protein, 99 aa, Homo Sapiens
  Brain
  SIGNAL -61..-1: Von Heijne matrix; score 3.80; seq LVMTFLFRNGSLQ/EK
MAAPPQLRALLVVVNALLRKRRYHAALAVLKGFRNGAVYGAKIRAPHALVMTFLFRNGSLQEKLWAILQATYIHSWNLARFVFTYKGLRALQSYIQGPG

SEQ ID NO: 1979 - protein, 79 aa, Homo Sapiens
  Brain
  SIGNAL -18..-1: Von Heijne matrix
  score 3.80
  seq GXALGLLPSLAKA/ED
  UNSURE -12: Xaa = His,Gln
  UNSURE 43: Xaa = Leu,Gln,Arg
MPVDLGXALGLLPSLAKAEDSQFSESDAALQEELSSPETARQLFRQFRYQVMSGPHETLKXLRKLCFQWLQPEVHTKEG

SEQ ID NO: 1980 - protein, 139 aa, Homo Sapiens
  Brain
  SIGNAL -72..-1: Von Heijne matrix; score 3.80; seq LMGLALAVYKCQS/MG
MNLFIMYMAGNTISIFPTMMVCMMAWRPIQALMAISATFKMLESSSQKFLQGLVYLIGNLMGLALAVYKCQSMGLLPTHASDWLAFIEPPERMESVVEDCFCEHEKAAPGPYVFGSYLHPSLSPVAPQHTLKLITYVKK

SEQ ID NO: 1981 - protein, 102 aa, Homo Sapiens
  Brain
  SIGNAL -51..-1: Von Heijne matrix; score 3.80; seq NVLFVAGLAFVIG/LE
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGLG

SEQ ID NO: 1982 - protein, 53 aa, Homo Sapiens
  Brain
  SIGNAL -33..-1: Von Heijne matrix
  score 3.60
  seq LAVFQMLKSMCAG/QR
  UNSURE -17: Xaa = Ser,Thr
MAASGAPRILVDLLKLXVAPLAVFQMLKSMCAGQRLASEPQDPAAVSLPTSSG

SEQ ID NO: 1983 - protein, 92 aa, Homo Sapiens
  Brain
  SIGNAL -26..-1: Von Heijne matrix; score 3.60; seq ARSLLQFLRLVGQ/LK
MASVSSATFSGHGARSLLQFLRLVGQLKRVPRTGWVYRNVQRPESVSDHMYRMAVMAMVIKDDRLNKDRCVRLALVHDMAECIVGDIAPADG

SEQ ID NO: 1984 - protein, 24 aa, Homo Sapiens [sequence omitted]

SEQ ID NO: 1985 - protein, 58 aa, Homo Sapiens
  Brain
  SIGNAL -42..-1: Von Heijne matrix
  score 3.50
  seq INSLLEXSSLSRC/LE
  UNSURE -7: Xaa = Ala,Thr
MFTFGRLFQIITVVTCLQFIQDCCIHSRQINSLLEXSSLSRCLEVPMYVKCIGSKIPL

SEQ ID NO: 1986 - protein, 62 aa, Homo Sapiens [sequence omitted]

SEQ ID NO: 1987 - protein, 48 aa, Homo Sapiens
  Brain
  SIGNAL -31..-1: Von Heijne matrix; score 11.30; seq LLLCLLWIGYSQG/TT
MKIIFPILSNPVFRRTVKLLLCLLWIGYSQGTTHVLRFGGIFEYVESG

SEQ ID NO: 1988 - protein, 57 aa, Homo Sapiens
  Brain
  SIGNAL -26..-1: Von Heijne matrix; score 6.60; seq LFWLASGWTPAFA/YS
MVSRMVSTMLSGLLFWLASGWTPAFAYSPRTPDRVSEADIQRLLHGVMEQLGIARPR

SEQ ID NO: 1989 - protein, 46 aa, Homo Sapiens
  Brain
  SIGNAL -24..-1: Von Heijne matrix
  score 4.80
  seq ATMVSGSSGLAXA/RL
  UNSURE -2: Xaa = Ala,Asp,Gly,Val
  UNSURE 6: Xaa = Ser,Thr
MTATLAAAADIATMVSGSSGLAXARLLSRXSSCRRMEFGIVPTQPR

SEQ ID NO: 1990 - protein, 69 aa, Homo Sapiens
  Liver
  SIGNAL -35..-1: Von Heijne matrix; score 15.00; seq LFLLLLLAASAWG/VT
MSSWSRQRPKSPGGIQPHVSRTLFLLLLLAASAWGVTLSPKDCQVFRSDHGSSISCQPPAEIPGYLPAT

SEQ ID NO: 1991 - protein, 96 aa, Homo Sapiens
  Hypertrophic prostate
  SIGNAL -21..-1: Von Heijne matrix
  score 13.20
  seq LLLXAVLLSLASA/SS
  UNSURE 49: Xaa = Cys,Phe,Ser,Tyr
  UNSURE -10: Xaa = Cys,Tyr
MRVRIGLTLLLXAVLLSLASASSDEEGSQDESLDSKTTLTSDESVKDHTTAGRVVAGQIFLDSEESELEXSIQEEEDSLKSQEGESVTEDISFLES

SEQ ID NO: 1992 - protein, 125 aa, Homo Sapiens
  Substantia nigra
  SIGNAL -21..-1: Von Heijne matrix
  score 13.10
  seq CVLLLLLLLLTRS/SE
  UNSURE 5: Xaa =  * ,Tyr
  UNSURE 6: Xaa = Lys,Arg
MFSHLPFDCVLLLLLLLLTRSSEVEXXAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNL

SEQ ID NO: 1993 - protein, 29 aa, Homo Sapiens
  kidney
  SIGNAL -21..-1: Von Heijne matrix; score 11.60; seq LLFLFLAVDEAWA/GM
MGPVRLGILLFLFLAVDEAWAGMLKEEGR

SEQ ID NO: 1994 - protein, 78 aa, Homo Sapiens
  Kidney
  SIGNAL -17..-1: Von Heijne matrix; score 10.70; seq SLLLAVALGLATA/VS
MKSLSLLLAVALGLATAVSAGPAVIECWFVEDASGKGLAKRPGALLLRQGPGEPPPRPDLDPELYLSVHDPAGALQAR

SEQ ID NO: 1995 - protein, 105 aa, Homo Sapiens
  Hypertrophic prostate
  SIGNAL -16..-1: Von Heijne matrix
  score 9.60
  seq LLTLXLLGGPTWA/GK
  UNSURE -9: Xaa = Ala,Asp,Glu,Gly,Val
  UNSURE 60: Xaa = Arg,Ser,Thr
  UNSURE 53: Xaa = Gly,Ser
  UNSURE 61: Xaa = Leu,Val
MLLLLTLXLLGGPTWAGKMYGPGGGKYFSTTEDYDHEITGLRVSVGLLLVKSVQVKLGDSWDVKLGALXGNTQEVXXQPGEYITKVFVAFQAFLRGMVMYTSKDR

SEQ ID NO: 1996 - protein, 77 aa, Homo Sapiens
  Cancerous prostate
  SIGNAL -46..-1: Von Heijne matrix
  score 9.40
  seq LIILIXIWIWCLG/SQ
  UNSURE -8: Xaa = Leu,Val
MKIGILLSLLNSVISQTLMSCNWKQQMRRMKTILIILIXIWIWCLGSQTFGTSTTKSVQLKILRQNLSHFLQPPQVI

SEQ ID NO: 1997 - protein, 94 aa, Homo Sapiens
  Brain
  SIGNAL -30..-1: Von Heijne matrix; score 9.40; seq LPFLLSLFPGALP/VQ
MKASSGRCGLVRWLQVLLPFLLSLFPGALPVQIRYSIPEELAKNSVVGNLAKDLGLSVRDLPARKLRVSAEKEYFTVNPESGDLLVSDRIDRDV

SEQ ID NO: 1998 - protein, 54 aa, Homo Sapiens
  Normal prostate
  SIGNAL -33..-1: Von Heijne matrix
  score 9.10
  seq IIFLCHLLRGLHA/XT
  UNSURE 1: Xaa = Ile,Leu
MIVDCVSSHLKKTGDGAKTFIIFLCHLLRGLHAXTDREKDPLMCENIQTHGRLP

SEQ ID NO: 1999 - protein, 109 aa, Homo Sapiens
  Ovary
  SIGNAL -104..-1: Von Heijne matrix
  score 9.10
  seq LTSLSWLLXASCS/KP
  UNSURE 3: Xaa =  * ,Cys
  UNSURE -27: Xaa = Ala,Ser
  UNSURE -79: Xaa = Cys,Phe,Tyr
  UNSURE -5: Xaa = Pro,Thr
MAKALLFPSGRSVRVLYGAVNKERQXESVLNRACPPKANSKERRGRAVLGAELTQWSSPTTAGSCCSSCTLCARSSSXVIAPSPLVPFTSGLTSLSWLLXASCSKPXKG

SEQ ID NO: 2000 - protein, 134 aa, Homo Sapiens
  Brain
  SIGNAL -73..-1: Von Heijne matrix
  score 8.00
  seq LATKLLSLSGVFA/VH
  UNSURE 39: Xaa =  * ,Ala,Asp,Glu,Phe,His,Ile,Lys,Leu,Asn,Pro,Gln,Ser,Thr,Val,Tyr
  UNSURE 33: Xaa =  * ,Glu,Lys,Gln
  UNSURE 51: Xaa = Ser,Thr
MAASEAAVVSSPSLKTDTSPVLETAGTVAAMAATPSARAAAAVVAAAARTGSEARVSKAALATKLLSLSGVFAVHKPKGPTSAELLNRLKEKLLAEAGMPSPEWTXRKKQTXENWAWRDSRQRXRGVLVVGIGA

SEQ ID NO: 2001 - protein, 44 aa, Homo Sapiens
  kidney
  SIGNAL -17..-1: Von Heijne matrix; score 7.80; seq VLWLISFFTFTDG/HG
MKVGVLWLISFFTFTDGHGGFLGVSWCYVSYLFSTNSPLSFRRM

SEQ ID NO: 2002 - protein, 119 aa, Homo Sapiens
  Surrenals
  SIGNAL -19..-1: Von Heijne matrix
  score 7.40
  seq WIFLAAILKGVQC/EV
  UNSURE 52: Xaa =  * ,Gly,Arg
  UNSURE 90: Xaa = Pro,Thr
MEFGLSWIFLAAILKGVQCEVQLVESGGGLVKPGGSLRLSCAASGFDFTDAWMSWVRQAPGKGLEWVANIXSTASGGTRGYAAPVKDRFIISRDDSRNTLHLQMNGLKXMTQAIYYCAT

SEQ ID NO: 2003 - protein, 150 aa, Homo Sapiens
  Cancerous prostate
  SIGNAL -37..-1: Von Heijne matrix
  score 7.40
  seq LWRLLLWAGTAFQ/VX
  UNSURE 72: Xaa =  * ,Ala,Glu,Gly,Lys,Leu,Met,Pro,Gln,Arg,Ser,Thr,Val,Trp
  UNSURE 55: Xaa =  * ,Cys,Ser,Trp
  UNSURE 2: Xaa = Ala,Asp,Asn,Thr
  UNSURE 6: Xaa = Glu,Gly
  UNSURE 10: Xaa = His,Gln
  UNSURE 56: Xaa = Phe,Ile,Leu,Val
  UNSURE 5: Xaa = Pro,Arg,Thr
  UNSURE 39: Xaa = Pro,Ser
MAEPGHSHHLSARVRGRTERRIPRLWRLLLWAGTAFQVXQGXXPELXACKESEYHYEYTACDSTGSRWRVAVPHTXGLCTSLPDPVKGTECXXSCNAGEFLDMKDQSCXPCAEGRYSLGTGIRFDEWDELPHGFAASQPTWSWMTVLLSH

SEQ ID NO: 2004 - protein, 105 aa, Homo Sapiens
  Umbilical cord
  SIGNAL -25..-1: Von Heijne matrix
  score 7.10
  seq QACLLGLFALILS/GK
  UNSURE 5: Xaa = Asp,His,Tyr
MTADPRKGRMGLQACLLGLFALILSGKCSXSPEPDQRRTLPPGWVSLGRADPEEELSLTFALRQQNVERLSELVQAVSDPSSPQYGKYLTLENVADLVRPSPLTP

SEQ ID NO: 2005 - protein, 87 aa, Homo Sapiens
  Normal prostate
  SIGNAL -24..-1: Von Heijne matrix
  score 6.90
  seq LCFLLLAVAMSFF/GS
  UNSURE 17: Xaa = Asp,Glu
  UNSURE 43: Xaa = Lys,Asn
MLVDGPSERPALCFLLLAVAMSFFGSALSIDETRAHLLLKXKMMRLGGRLVLNTKEELANERLMTLXIAEMKEAMRTLIFPPSMHFF

SEQ ID NO: 2006 - protein, 128 aa, Homo Sapiens
  Brain
  SIGNAL -17..-1: Von Heijne matrix; score 6.80; seq LVLVLVVAVTVRA/AL
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIR

SEQ ID NO: 2007 - protein, 132 aa, Homo Sapiens
  Substantia nigra
  SIGNAL -102..-1: Von Heijne matrix
  score 6.70
  seq LXMTLMLPFKILS/DS
  UNSURE -12: Xaa = Ile,Met
MTAAIRRQRELSILPKVTLEAMNTTVMQGFNRSERCPRDTRIVQLVFPALYTVVFLTGILLNTLALWVFVHIPSSSTFIIYLKNTLVADLXMTLMLPFKILSDSHLAPWQLRAFVCRFSSVIFYETMYVGEG

SEQ ID NO: 2008 - protein, 59 aa, Homo Sapiens
  Spleen
  SIGNAL -46..-1: Von Heijne matrix; score 6.30; seq SIGVLTLSHLISG/LR
MSSVLAASHPLVLSSNAGTPGISEKDNRDPAGSSIGVLTLSHLISGLRTLYTLLHFPLR

SEQ ID NO: 2009 - protein, 105 aa, Homo Sapiens
  Thyroid
  SIGNAL -50..-1: Von Heijne matrix
  score 6.30
  seq LIILGLVLFMVYG/NV
  UNSURE 22: Xaa = Ile,Ser
MGLAMEHGGSYARAGGSSRGCWYYLRYFFLFVSLIQFLIILGLVLFMVYGNVHVSTESNLQATERRAEGLYXQLLGLTASQSNLTKELNFTTRAKDAIMQMWLNA

SEQ ID NO: 2010 - protein, 66 aa, Homo Sapiens
  Cancerous prostate
  SIGNAL -64..-1: Von Heijne matrix; score 6.30; seq SCLVSGWGLLANG/QR
MVEASLSVRHPEYNRPLLANDLMLIKLDESVSESDTIRSISIASQCPTAGNSCLVSGWGLLANGQR

SEQ ID NO: 2011 - protein, 142 aa, Homo Sapiens
  Cancerous prostate
  SIGNAL -47..-1: Von Heijne matrix
  score 6.30
  seq VICCVLFLLFILG/YI
  UNSURE 80: Xaa =  * ,Cys,Asp,Glu,Phe,Gly,His,Ile,Lys,Leu,Met,Asn,Gln,Arg,Ser,Val,Trp,Tyr
  UNSURE 81: Xaa = Glu,Gly
MGGKQRDEDDEAYGKPVKYDPSFRGPIKNRSCTDVICCVLFLLFILGYIVVGIVAWLYGDPRQVLYPRNSTGAYCGMGENKDKPYLLYFNIFSCILSSNIISVAENGLQCPTPQVCVSSCPEDPWTXXKTSSHRLLGKSSIQ

SEQ ID NO: 2012 - protein, 120 aa, Homo Sapiens
  Hypertrophic prostate
  SIGNAL -18..-1: Von Heijne matrix; score 6.30; seq VLLFLAWVCFLFY/AG
MQKASVLLFLAWVCFLFYAGIALFTSGFLLTRLELTNHSSCQEPPGPGSLPWGSQGKPGACWMASRFSRVVLVLIDALRFDFAQPQHSHVPREPPVSLPFLGKLSSLQRILEIQPHHARL

SEQ ID NO: 2013 - protein, 90 aa, Homo Sapiens
  Lung
  SIGNAL -81..-1: Von Heijne matrix
  score 5.70
  seq CWMMLLGSXGSFL/AP
  UNSURE -5: Xaa = Ala,Pro
  UNSURE 6: Xaa = Cys,Ser
MSPVLHFYVRPSGHEGAASGHTRRKLQGKLPELQGVETELCYNVNWTAEALPSAEETKKLMWLFGCPYCWMMLLGSXGSFLAPMTCXWRS

SEQ ID NO: 2014 - protein, 78 aa, Homo Sapiens
  Brain
  SIGNAL -36..-1: Von Heijne matrix; score 5.60; seq ILRLLGSLSNAYS/PR
MDVTPRESLSILVVAGSGGHTTEILRLLGSLSNAYSPRHYVIADTDEMSANKINSFELDRADRDPSNMYTKYYIHRNG

SEQ ID NO: 2015 - protein, 58 aa, Homo Sapiens
  kidney
  SIGNAL -21..-1: Von Heijne matrix
  score 5.60
  seq LLRVLNLPHNSIG/CV
  UNSURE 27: Xaa = Ile,Val
MMGVAKLTLLRVLNLPHNSIGCVEGLKELVHLEWLNLAGNNLKAMEQXNSCTALQHLD

SEQ ID NO: 2016 - protein, 65 aa, Homo Sapiens
  Brain
  SIGNAL -36..-1: Von Heijne matrix; score 5.60; seq ILRLLGSLSNAYS/PR
MDVTPRESLSILVVAGSGGHTTEILRLLGSLSNAYSPRHYVIADTDEMSANKINSFELDRADRDR

SEQ ID NO: 2017 - protein, 31 aa, Homo Sapiens
  Colon
  SIGNAL -13..-1: Von Heijne matrix; score 5.50; seq MVLLTMIARVADG/LP
MVLLTMIARVADGLPLAASMQEEVRTAPRAL

SEQ ID NO: 2018 - protein, 89 aa, Homo Sapiens
  Cancerous prostate
  SIGNAL -47..-1: Von Heijne matrix
  score 5.30
  seq GCGMFTFLSSVXA/AV
  UNSURE -2: Xaa = Ile,Asn,Ser,Thr
  UNSURE -23: Xaa = Ile,Ser
  UNSURE 27: Xaa = Leu,Met,Val
MVPVENTEGPSLLNQKGTAVETEGXGSRHPPWARGCGMFTFLSSVXAAVSGLLVGYELGIISGALLQIKTLLAXSCHEQEMVVSSLVIG

SEQ ID NO: 2019 - protein, 47 aa, Homo Sapiens
  Cancerous prostate
  SIGNAL -24..-1: Von Heijne matrix
  score 5.20
  seq LLFPVGRSWSCFA/QT
  UNSURE 3: Xaa = Leu,Pro,Arg
METFLEPNNKKLLFPVGRSWSCFAQTXSLAKYIPYSLWKYSVLSGHS

SEQ ID NO: 2020 - protein, 110 aa, Homo Sapiens
  Normal prostate
  SIGNAL -15..-1: Von Heijne matrix
  score 5.10
  seq FLWGLALPLFFFC/WE
  UNSURE 84: Xaa =  * ,Ala,Asp,Glu,Phe,Leu,Ser,Val,Tyr
  UNSURE 92: Xaa =  * ,Asp,Glu,Lys,Asn,Tyr
  UNSURE 91: Xaa = Arg,Ser
  UNSURE 93: Xaa = Ile,Asn,Ser,Thr
MGFLWGLALPLFFFCWEVGVSGSSAGPSTRRADTAMTTDDTEVPAMTLAPGHAALETQTLSAETSSRASTPAGPVPEAETRGAKRISPARETRSFTKTXPNFMVLXXXVT

SEQ ID NO: 2021 - protein, 78 aa, Homo Sapiens
  Spleen
  SIGNAL -21..-1: Von Heijne matrix; score 4.90; seq WLLSDILGQGATA/NV
MQSTSNHLWLLSDILGQGATANVFRGRHKKTGDLFAIKVFNNISFLRPVDVQMREFEVLKKLNHKNIVKLFAIEEETG

SEQ ID NO: 2022 - protein, 39 aa, Homo Sapiens
  Lymphocytes
  SIGNAL -16..-1: Von Heijne matrix; score 4.90; seq ICAGSVLPPYSNC/QM
MVEICAGSVLPPYSNCQMPEPSIFTLIHFHTYYCLTTPQ

SEQ ID NO: 2023 - protein, 73 aa, Homo Sapiens
  Brain
  SIGNAL -43..-1: Von Heijne matrix
  score 4.70
  seq LLAFGTSCSVVXY/XP
  UNSURE 10: Xaa = Asn,Ser
  UNSURE 1: Xaa = Asp,Gly
  UNSURE 25: Xaa = Cys,Gly
  UNSURE -19: Xaa = Cys,Ser
  UNSURE 28: Xaa = Glu,Gly
  UNSURE 12: Xaa = His,Asn
  UNSURE 4: Xaa = Ile,Lys,Asn
  UNSURE -2: Xaa = Leu,Arg
MVAPVLETSHVFCCPNRVRGVLNWXSGPRGLLAFGTSCSVVXYXPLXRVVVTXLXGHTARVNCIQWIXKQXGM

SEQ ID NO: 2024 - protein, 117 aa, Homo Sapiens
  Lymph ganglia
  SIGNAL -70..-1: Von Heijne matrix
  score 4.70
  seq QLLLATLQEAATT/QE
  UNSURE 21: Xaa = Ala,Cys,Asp,Phe,Gly,His,Ile,Leu,Asn,Pro,Arg,Ser,Thr,Val,Tyr
  UNSURE -54: Xaa = Gly,Arg
MDSLRKMLISVAMLGAXAGVGYALLVIVTPGERRKQEMLKEMPLQDPRSREEAARTQQLLLATLQEAATTQENVAWRKNWMVGGEGGATGXHRETGLASVGAGPWLGRRNPRQLSPS

SEQ ID NO: 2025 - protein, 91 aa, Homo Sapiens
  Hypertrophic prostate
  SIGNAL -26..-1: Von Heijne matrix; score 4.60; seq LLPFGMLCASSTT/KC
MRQTLPCIYFWGGLLPFGMLCASSTTKCTVSHEVADCSHLKLTQVPDDLPTNITVLNLTHNQLRRLPAANFTRYSQLTSLDVGFNTISKLE

SEQ ID NO: 2026 - protein, 134 aa, Homo Sapiens
  Cancerous prostate
  SIGNAL -110..-1: Von Heijne matrix
  score 4.60
  seq HTXGLLGFGRXQG/SI
  UNSURE -19: Xaa = Asn,Ser
  UNSURE 18: Xaa = Glu,Gly
  UNSURE 10: Xaa = Glu,Lys
  UNSURE 15: Xaa = Lys,Thr
  UNSURE -11: Xaa = Phe,Leu
  UNSURE -3: Xaa = Ser,Thr
MADDLEQQSQGWLSSWLPTWRPTSMSQLKNVEARILQCLQNKFLARYVSLPNQNKIWTVTVSPEQNDRTPLVMVHGFGGGVGLWILNMDSLXARRTLHTXGLLGFGRXQGSIPKGPEGLXDEFVXSIXTWRETW

SEQ ID NO: 2027 - protein, 66 aa, Homo Sapiens
  Large intestine
  SIGNAL -24..-1: Von Heijne matrix
  score 4.50
  seq PLSMILLSDKIQS/SK
  UNSURE 35: Xaa = Asp,Glu,Gly,His,Ile,Lys,Leu,Met,Asn,Gln,Arg,Ser,Val
MKVTGITILFWPLSMILLSDKIQSSKREVQCNFTEKNYTLIPADIKKDVTILDLSYNQXTLNGTDT

SEQ ID NO: 2028 - protein, 107 aa, Homo Sapiens
  Brain
  SIGNAL -96..-1: Von Heijne matrix; score 4.40; seq HLSWSSSAYQAWA/QE
MAAGRAQVPSSEQAWLEDAQVFIQKTLCPAVKEPNVQLTPLVIDCVKTVWLSQGRNQGSTLPLSYSFVSVQDLKTHQRLPCCSHLSWSSSAYQAWAQEAGPNGNPPG

SEQ ID NO: 2029 - protein, 42 aa, Homo Sapiens
  Normal prostate
  SIGNAL -14..-1: Von Heijne matrix; score 4.00; seq STCCWCTPGGAST/ID
MSTCCWCTPGGASTIDFLKRYASNTPSGEFQTADEDLCYCLG

SEQ ID NO: 2030 - protein, 53 aa, Homo Sapiens
  Cancerous prostate
  SIGNAL -36..-1: Von Heijne matrix
  score 3.90
  seq VVEILPYLPCLTA/RD
  UNSURE -16: Xaa = Asp,Asn,Tyr
MPFAEDKTYKYICRNFSNFCXVDVVEILPYLPCLTARDQDRLRATCTLSGNRA

SEQ ID NO: 2031 - protein, 117 aa, Homo Sapiens
  Lymph ganglia
  SIGNAL -107..-1: Von Heijne matrix
  score 3.90
  seq IVLVLLLGRYTEE/EQ
  UNSURE -33: Xaa = Asp,Glu
  UNSURE -26: Xaa = Gly,Ser
  UNSURE 9: Xaa = Lys,Arg
MAESEDRSLRIVLVGKTGSGKSATANTILGEEIFDSRIAAQAVTKNCQKASREWQGRDLLVVDTPGLFDTKESLXTTCKEIXRCIISSCPGPHAIVLVLLLGRYTEEEQKTVALIXL

SEQ ID NO: 2032 - protein, 99 aa, Homo Sapiens
  Lung
  SIGNAL -49..-1: Von Heijne matrix
  score 3.80
  seq LLXCVGNFFGSTQ/DA
  UNSURE -11: Xaa = Leu,Trp
  UNSURE -19: Xaa = Lys,Arg
MAQKPLRLLACGDVEGKFDILFNRVQAIQKXSGNFDLLXCVGNFFGSTQDAEWEEYKTGIKKAPIQTYVLGANNQETVKYFQDADGCELAENITYLGRG

SEQ ID NO: 2033 - protein, 109 aa, Homo Sapiens
  Hypertrophic prostate
  SIGNAL -52..-1: Von Heijne matrix
  score 3.80
  seq RPVLLHLHQTAHA/DE
  UNSURE 43: Xaa = Ile,Asn,Ser,Thr
  UNSURE 31: Xaa = Ser,Thr
MESRKDITNQEELWKMKPRRNLEEDDYLHKDTGETSMLKRPVLLHLHQTAHADEFDCPSELQHTQQLFPQWHLPIKIAAIIAXLTFLYTLLREVXHPLATSHQQYFYKI

SEQ ID NO: 2034 - protein, 66 aa, Homo Sapiens
  Testis
  SIGNAL -52..-1: Von Heijne matrix
  score 3.80
  seq RPVLLHLHQTAHA/DE
  UNSURE -40: Xaa = Ile,Leu
MESRKDITNQEEXWKMKPRRNLEEDDYLHKDTGETSMLKRPVLLHLHQTAHADEFDCPSELQHTQG

SEQ ID NO: 2035 - protein, 89 aa, Homo Sapiens
  Colon
  SIGNAL -36..-1: Von Heijne matrix
  score 3.70
  seq STLASVPPAATFG/AD
  UNSURE 30: Xaa = Phe,Ser,Tyr
MAATCEISNIFSNYFSAMYSSEDSTLASVPPAATFGADDLVLTLSNPQMSLEGTEKASWLGEQPQXWSKTQVLDWISYQVEKNKYDATG

SEQ ID NO: 2036 - protein, 123 aa, Homo Sapiens
  Muscle
  SIGNAL -58..-1: Von Heijne matrix
  score 3.50
  seq LVSFAVSSEGTEQ/GE
  UNSURE -44: Xaa = Ala,Asp
  UNSURE -50: Xaa = Ala,Gly,Val
  UNSURE 31: Xaa = Asp,Glu
  UNSURE 53: Xaa = Lys,Asn
  UNSURE 40: Xaa = Lys,Thr
MRDCPGVEXILDCSXRQKTEGCRLQAGKECVDSPVEGGQSEAPPSLVSFAVSSEGTEQGEDPRSEKDHSRPHKHRARHARLRRSESLSXKQVKEAKSXCKSIALLLTDAPXPNSKGVLMFKKR

SEQ ID NO: 2037 - protein, 58 aa, Homo Sapiens
  Cancerous prostate
  SIGNAL -37..-1: Von Heijne matrix; score 3.50; seq LVFNFLLILTILT/IW
MERQSRVMSEKDEYQFQHQGAVELLVFNFLLILTILTIWLFKNHRFRFLHETGGAMVY

SEQ ID NO: 2038 - protein, 50 aa, Homo Sapiens
  Cancerous prostate
  SIGNAL -29..-1: Von Heijne matrix
  score 13.40
  seq SLLLVQLLTPCSA/QF
  UNSURE 6: Xaa =  * ,Gly
  UNSURE 7: Xaa = Pro,Ser
MKMASSLAFLLLNFHVSLLLVQLLTPCSAQFSVLXXSGPILAMVGEDADL

SEQ ID NO: 2039 - protein, 41 aa, Homo Sapiens
  Normal prostate
  SIGNAL -32..-1: Von Heijne matrix; score 12.60; seq LLALLTVSTPSWC/QS
MVFLPLKWSLATMSFLLSSLLALLTVSTPSWCQSTEASPKR

SEQ ID NO: 2040 - protein, 33 aa, Homo Sapiens
  Hypertrophic prostate
  SIGNAL -26..-1: Von Heijne matrix
  score 11.80
  seq SLLLLLLXCVHWS/QP
  UNSURE -6: Xaa = Ser,Thr
MESAAALHFSRPASLLLLLLXCVHWSQPSLLSW

SEQ ID NO: 2041 - protein, 116 aa, Homo Sapiens
  Normal prostate
  SIGNAL -20..-1: Von Heijne matrix; score 11.20; seq AFLLLVALSYTLA/RD
MEKIPVSAFLLLVALSYTLARDTTVKPGAKKDTKDSRPKLPQTLSRGWGDQLIWTQTYEEALYKSKTSNKPLMIIHHLDECPHSQALKKVFAENKEIQKLAEQFVLLNLVYETTDK

SEQ ID NO: 2042 - protein, 72 aa, Homo Sapiens
  Umbilical cord
  SIGNAL -46..-1: Von Heijne matrix; score 10.30; seq LVLLLVLTLLCSL/VP
MGPWGEPELLVWRPEAVASEPPVPVGLEVKLGALVLLLVLTLLCSLVPICVLRRPGANHEGSASRQKALSPK

SEQ ID NO: 2043 - protein, 118 aa, Homo Sapiens
  Cancerous prostate
  SIGNAL -16..-1: Von Heijne matrix; score 10.10; seq LLLQLAVLGAALA/AA
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSK

SEQ ID NO: 2044 - protein, 127 aa, Homo Sapiens
  Lymphocytes
  SIGNAL -27..-1: Von Heijne matrix
  score 9.80
  seq SALLVGFLSVIFA/LV
  UNSURE -17: Xaa = Ala,Thr
  UNSURE 23: Xaa = Asp,Gly,His,Arg
  UNSURE 61: Xaa = Gly,Arg
MAMEGYWRFLXLLGSALLVGFLSVIFALVWVLHYREGLGWDGSALEFNWXPVLMVTGFVFIQGIAIIVYRLPWTWKCSKLLMKSIHAXLNAVAAILAIISVVAVFENHNVNNIANMYSLHSWVGLIA

SEQ ID NO: 2045 - protein, 129 aa, Homo Sapiens
  Lymph ganglia
  SIGNAL -17..-1: Von Heijne matrix; score 9.30; seq LALSLLILVLAFG/IP
MAQSLALSLLILVLAFGIPRTQGSDGGAQDCCLKYSQRKIPAKVVRSYRKQEPSLGCSIPAILFLPRKRSQAELCADPKELWVQQLMQHLDKTPSPQKPAQGCRKDRGASKTGKKGKGSKGCKRTERSQ

SEQ ID NO: 2046 - protein, 56 aa, Homo Sapiens
  Brain
  SIGNAL -15..-1: Von Heijne matrix
  score 8.40
  seq AMWLLCVALAVLA/WG
  UNSURE 20: Xaa = Gly,Arg
MEAMWLLCVALAVLAWGFLWVWDSSERMKSREQGXRLGAESRTLLVIAHPDDEAMW

SEQ ID NO: 2047 - protein, 72 aa, Homo Sapiens
  Brain
  SIGNAL -38..-1: Von Heijne matrix
  score 7.80
  seq LVFTVSLFAWICC/QR
  UNSURE 20: Xaa =  * ,Lys
MAPITTSREEFDEIPTVVGIFSAFGLVFTVSLFAWICCQRKSSKSNKTPPYKFVHVLXGVDIYPENLNSKKK

SEQ ID NO: 2048 - protein, 121 aa, Homo Sapiens
  Umbilical cord
  SIGNAL -18..-1: Von Heijne matrix; score 7.40; seq GWLVLCVLAISLA/SM
MEGPRGWLVLCVLAISLASMVTEDLCRAPDGKKGEAGRPGRRGRPGLKGEQGEPGAPGIRTGIQGLKGDQGEPGPSGNPGKVGYPGPSGPLGARGIPGIKGTKGSPGNIKDQPRPAFSAIR

SEQ ID NO: 2049 - protein, 79 aa, Homo Sapiens
  Muscle
  SIGNAL -63..-1: Von Heijne matrix
  score 7.20
  seq VLLTLLLIAFIFL/II
  UNSURE -39: Xaa = Ala,Pro
  UNSURE -30: Xaa = His,Leu,Pro,Arg
  UNSURE -38,-37: Xaa = Pro,Gln
MTAWEAMAPHVNPTLKDKALSPQQXXXTSPAPCXSNHHNKKHLILAFCAGVLLTLLLIAFIFLIIKSYRKYHSKPQAPG

SEQ ID NO: 2050 - protein, 66 aa, Homo Sapiens
  kidney
  SIGNAL -18..-1: Von Heijne matrix
  score 7.10
  seq LLCECLLLXAGYA/HD
  UNSURE -5: Xaa = Ala,Val
  UNSURE 44: Xaa = Asp,Gly
MLCSLLLCECLLLXAGYAHDDDWIDPTDMLNYDAASGTMRKSQAKYGISGEKDVSPDLSCAXEISE

SEQ ID NO: 2051 - protein, 46 aa, Homo Sapiens
  kidney
  SIGNAL -19..-1: Von Heijne matrix
  score 6.90
  seq LVXSLPVHCLTFA/SS
  UNSURE 15: Xaa = Asn,Thr
  UNSURE 20: Xaa = His,Gln
  UNSURE -11: Xaa = Leu,Val
MGHAMGLVXSLPVHCLTFASSAPSSPQPTRMWFXAQAHXPPLILGP

SEQ ID NO: 2052 - protein, 116 aa, Homo Sapiens
  Umbilical cord
  SIGNAL -16..-1: Von Heijne matrix; score 6.70; seq CFSLVLLLTSIWT/TR
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIW

SEQ ID NO: 2053 - protein, 65 aa, Homo Sapiens [sequence omitted]

SEQ ID NO: 2054 - protein, 72 aa, Homo Sapiens
  Cancerous prostate
  SIGNAL -28..-1: Von Heijne matrix; score 6.60; seq IVSLLGFVATVTL/IP
MWAFSELPMPLLINLIVSLLGFVATVTLIPAFRGHFIAARLCGQDLNKTSRQQIPESQGVISGAVFLIILFC

SEQ ID NO: 2055 - protein, 82 aa, Homo Sapiens
  Hypertrophic prostate
  SIGNAL -23..-1: Von Heijne matrix; score 5.40; seq PASLSLLTFKVYA/AP
MFKVIQRSVGPASLSLLTFKVYAAPKKDSPPKNSVKVDELSLYSVPEGQSKYVEEARSQLEESISQLRHYCEPYTTWCQETY

SEQ ID NO: 2056 - protein, 140 aa, Homo Sapiens
  kidney
  SIGNAL -136..-1: Von Heijne matrix; score 5.40; seq LISVALVQGWALG/GG
MAKSLLKTASLSGRTKLLHQTGLSLYSTSHGFYEEEVKKTLQQFPGGSIDLQKEDNGIGILTLNNPSRMNAFSGVMMLQLLEKVIELENWTEGKGLIVRGAKNTFSSGSDLNAVKSLGLQRLPLISVALVQGWALGGGAA

SEQ ID NO: 2057 - protein, 64 aa, Homo Sapiens
  Substantia nigra
  SIGNAL -44..-1: Von Heijne matrix
  score 5.30
  seq PLLKILHAAGAQG/EM
  UNSURE -19: Xaa = Ala,Glu,Gly,Pro,Gln,Arg
MTSFSTSAQCSTSDSACRISPGQINXVRPKLPLLKILHAAGAQGEMFTVKEVMHYLGQYIMVKQ

SEQ ID NO: 2058 - protein, 158 aa, Homo Sapiens
  Lung (cells)
  SIGNAL -112..-1: Von Heijne matrix
  score 5.10
  seq AFAWLGVVPLTAC/RI
  UNSURE -79: Xaa = Phe,Leu
MDTAEEDICRVCRSEGTPEKPLYHPCVCTGSIKXVHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFI

SEQ ID NO: 2059 - protein, 41 aa, Homo Sapiens
  Brain
  SIGNAL -13..-1: Von Heijne matrix
  score 4.90
  seq MLIMLGIFFNVHS/AV
  UNSURE 16: Xaa = Ile,Asn,Ser,Thr
MLIMLGIFFNVHSAVLIEDVPFTEKDFEXGPQNIYNLYEHG

SEQ ID NO: 2060 - protein, 114 aa, Homo Sapiens
  Normal prostate
  SIGNAL -112..-1: Von Heijne matrix
  score 4.50
  seq AAVAVGMLXASYA/AV
  UNSURE -5: Xaa = Gly,Arg,Trp
  UNSURE -29: Xaa = Gly,Leu,Arg,Val
  UNSURE -22: Xaa = Lys,Gln
MGGLWRPGWRCVPFCGWRWIHPGSPTRAAERVEPFLRPEWSGTGGAERGLRWLGTWKRCSLRARHPALQPPRRPKSSNPFTRAXEEERRRXNKTTLTYVAAVAVGMLXASYAAV

SEQ ID NO: 2061 - protein, 96 aa, Homo Sapiens
  kidney
  SIGNAL -39..-1: Von Heijne matrix
  score 4.20
  seq SDPLCVLFLNTSG/QQ
  UNSURE 44: Xaa = Asp,Gly
MAAQCVTKVALNVSCANLLDKDIGSKSDPLCVLFLNTSGQQWYEVERTERIKNCLNPQFSKTFIIDYYFEVVQKLKFGVYDIXNKTIELSDDDFLG

SEQ ID NO: 2062 - protein, 107 aa, Homo Sapiens
  kidney
  SIGNAL -70..-1: Von Heijne matrix
  score 3.70
  seq AVLDCAFYDPTHA/WS
  UNSURE 8: Xaa = His,Pro,Gln
  UNSURE 9: Xaa = Leu,Val
MTGSNEFKLNQPPEDGISSVKFSPNTSQFLLVSSWDTSVRLYDVPANSMRLKYQHTGAVLDCAFYDPTHAWSGGLDHXXKMHDLNTDQENLVGTHDAPIRCVEYCPS

SEQ ID NO: 2063 - protein, 48 aa, Homo Sapiens
  Brain
  SIGNAL -25..-1: Von Heijne matrix; score 3.60; seq AHLCWCGSHCCST/CV
MGKHLWYPGQASAHLCWCGSHCCSTCVFEDQLSDERFQRSNAPSVNSD

SEQ ID NO: 2064 - protein, 73 aa, Homo Sapiens
  kidney
  SIGNAL -13..-1: Von Heijne matrix
  score 3.50
  seq MLAVSLTVXLLGA/MM
  UNSURE -5: Xaa = Leu,Pro,Arg
MLAVSLTVXLLGAMMLLESPIDPQPLSFKEPPLLLGVLHPNTKLRQAERLFENQLVGPESIAHIGDVMFTGSW

SEQ ID NO: 2065 - protein, 86 aa, Homo Sapiens
  Ovary
  SIGNAL -76..-1: Von Heijne matrix; score 3.50; seq MLELDLLVFHLWG/SQ
MSSTLAKIAEIEAEMARTQKNKATAHHLGLLKARLAKLRRELITPKGGGGGGPGEGFDWPRQVMLELDLLVFHLWGSQHCLVTWQG

SEQ ID NO: 2066 - protein, 57 aa, Homo Sapiens
  kidney
  SIGNAL -45..-1: Von Heijne matrix; score 13.90; seq LVLALLLVSAALS/SV
MAAAVPKRMRGPAQAKLLPGSAIQALVGLARPLVLALLLVSAALSSVVSRTDSPSPL

SEQ ID NO: 2067 - protein, 63 aa, Homo Sapiens
  kidney
  SIGNAL -25..-1: Von Heijne matrix
  score 13.90
  seq LLSLLFLVQGAHG/RG
  UNSURE 28: Xaa = Asp,Glu
MTPQSLLQTTLFLLSLLFLVQGAHGRGHREDFRFCSQRNQTHRSSLHYKPTPXLRISIENSEE

SEQ ID NO: 2068 - protein, 127 aa, Homo Sapiens
  Testis
  SIGNAL -88..-1: Von Heijne matrix
  score 11.60
  seq ILLCLLLALFASG/LI
  UNSURE 4: Xaa = Gln,Arg
MMVVGTGTSLALSSLLSLLLFAGMQIYSRQLASTEWLTIQGGLLGSGLFVFSLTAFNNLENLVFGKGFQAKIFPEILLCLLLALFASGLIHXVCVTTCFIFSRVGLYYINKISSTLYQAAAPVLTPA

SEQ ID NO: 2069 - protein, 134 aa, Homo Sapiens
  Lymph ganglia
  SIGNAL -19..-1: Von Heijne matrix; score 11.60; seq VFCLLAVAPGAHS/QE
MDWTWRVFCLLAVAPGAHSQEQLVQSGAEVLKPGASVNISCRASGFTFTNYYVHWVRQAPGHGLEWMGVINPVSGYTSYAQKLQGRLTMTTDTAANIVYMDLSRLKSDDTAVYFCAKVRCLKGICYTEDALDLW

SEQ ID NO: 2070 - protein, 139 aa, Homo Sapiens
  Umbilical cord
  SIGNAL -113..-1: Von Heijne matrix
  score 11.60
  seq ILLCLLLALFASG/LI
  UNSURE -76: Xaa = Cys,Ser,Trp
MRIANRTRFSSPFLARGAGWTHGRGMMVVGTGTSLALXSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISS

SEQ ID NO: 2071 - protein, 53 aa, Homo Sapiens
  Heart
  SIGNAL -24..-1: Von Heijne matrix; score 11.40; seq LMSLLLVLPVVEA/VE
MTSVSTQLSLVLMSLLLVLPVVEAVEAGDAIALLLGVVLSITGIVPAWGYMHG

SEQ ID NO: 2072 - protein, 33 aa, Homo Sapiens
  Brain
  SIGNAL -20..-1: Von Heijne matrix
  score 11.20
  seq ILVVLMGLPLAQA/LD
  UNSURE 7: Xaa = Ala,Pro,Ser,Thr
MTPLLTLILVVLMGLPLAQALDCHVCXYNGDNC

SEQ ID NO: 2073 - protein, 124 aa, Homo Sapiens
  Lymph ganglia
  SIGNAL -16..-1: Von Heijne matrix
  score 11.00
  seq LLALSLLVLWTSP/AP
  UNSURE 83: Xaa =  * ,Glu
  UNSURE 79: Xaa = Arg,Ser
  UNSURE 86: Xaa = Asn,Thr
  UNSURE 100: Xaa = Asp,Tyr
  UNSURE 107: Xaa = Gly,Arg
  UNSURE 88: Xaa = Lys,Gln
  UNSURE 103: Xaa = Pro,Thr
MALLLALSLLVLWTSPAPTLSGTNDAEDCCLSVTQKPIPGYIVRNFHYLLIKDGCRVPAVVFTTLRGRQLCAPPDQPWVERIIQRLQRTSAKMKXRSSXPMXVXREPESESSIVNXYLXGERXR

SEQ ID NO: 2074 - protein, 103 aa, Homo Sapiens
  Umbilical cord
  SIGNAL -21..-1: Von Heijne matrix
  score 10.50
  seq RLLLLPLLLAVSG/LR
  UNSURE 57: Xaa = Ala,Glu,Gly,Leu,Pro,Gln,Arg,Val
MGGLEPCSRLLLLPLLLAVSGLRPVQAQAQSDCSCSTVSPGVLAGIVMGDLVLTVLIALAVYFLGRLVPRGRGAAEAXTRKQRITETGSPYQELQGQRSDVYS

SEQ ID NO: 2075 - protein, 82 aa, Homo Sapiens
  kidney
  SIGNAL -24..-1: Von Heijne matrix
  score 10.00
  seq LCRALCLFPRVFA/AE
  UNSURE 21: Xaa = Leu,Val
  UNSURE 38: Xaa = Phe,Leu
MEVPPPAPRSFLCRALCLFPRVFAAEAVTADSEVLEERQKRLPYXPEPYYRNLDGTASGSCXAKMNSREFQRTLLISVRRQL

SEQ ID NO: 2076 - protein, 94 aa, Homo Sapiens
  Cancerous prostate
  SIGNAL -19..-1: Von Heijne matrix
  score 9.50
  seq LMCLSLCTAFALS/KP
  UNSURE 41: Xaa = Arg,Ser,Thr
  UNSURE 27: Xaa = Asp,Val
MDLRQFLMCLSLCTAFALSKPTEKKDRVHHEPQLSDKVHNDAQSFXYDHDAFLGAEEAKXFDQLTPEESKERLGKIVSKIDGDKDGFVTVDELK

SEQ ID NO: 2077 - protein, 99 aa, Homo Sapiens
  Substantia nigra
  SIGNAL -30..-1: Von Heijne matrix
  score 9.50
  seq LLFLSQFCILSGG/ES
  UNSURE 45: Xaa = Ala,Thr
  UNSURE 62: Xaa = Asp,Asn
MAGGVRPLRGLRALCRVLLFLSQFCILSGGESTEIPPYVMKCPSNGLCSRLPADCIDSTTNFSCTYGKPVTFDCXVKPSVTCVDQDFKSQKXFIINMTC

SEQ ID NO: 2078 - protein, 118 aa, Homo Sapiens
  Umbilical cord
  SIGNAL -21..-1: Von Heijne matrix
  score 9.30
  seq VLPVILLLLGAHP/SP
  UNSURE 36: Xaa = Ile,Lys,Met,Asn,Thr
  UNSURE 60: Xaa = Ile,Thr
MAAAAWLQVLPVILLLLGAHPSPLSFFSAGPATVAAADRSKWHIPIPSGKNYFSFGXILFRNTTIFLKFDGEPCDLSLNIXWYLKSADCYNEIYNFKAEEVELYLEKLKEKRGLSGKW

SEQ ID NO: 2079 - protein, 31 aa, Homo Sapiens
  Substantia nigra
  SIGNAL -19..-1: Von Heijne matrix
  score 9.30
  seq LLWLALACSPVHT/XL
  UNSURE 8: Xaa = Ala,Gly,Pro,Arg,Thr
  UNSURE 1: Xaa = Ser,Thr
MRTLFNLLWLALACSPVHTXLSKSDAXKPPR

SEQ ID NO: 2080 - protein, 60 aa, Homo Sapiens
  Muscle
  SIGNAL -16..-1: Von Heijne matrix
  score 9.30
  seq LFVAIFAVPLILG/QE
  UNSURE 39: Xaa = Ala,Ser
  UNSURE 29: Xaa = Ala,Thr
  UNSURE 33: Xaa = Asp,Asn
  UNSURE 32: Xaa = Pro,Thr
MDVLFVAIFAVPLILGQEYEDEERLGEDEYYQVVYYYTVTPIMMXLGXXFTIDYXIFESE

SEQ ID NO: 2081 - protein, 108 aa, Homo Sapiens
  Substantia nigra
  SIGNAL -21..-1: Von Heijne matrix; score 9.30; seq VLPVILLLLGAHP/SP
MAAAAWLQVLPVILLLLGAHPSPLSFFSAGPATVAAADRSKWHIPIPSGKNYFSFGKILFRNTTIFLKFDGEPCDLSLNITWYLKSADCYNEIYNFKAEEVELYLEKL

SEQ ID NO: 2082 - protein, 55 aa, Homo Sapiens
  brain
  SIGNAL -19..-1: Von Heijne matrix
  score 9.20
  seq LLXLALACSPVHT/TL
  UNSURE -11: Xaa = Leu,Trp
MRTLFNLLXLALACSPVHTTLSKSDAKKAASKTLLEKSQFSDKPVQDRGLVVTDG

SEQ ID NO: 2083 - protein, 70 aa, Homo Sapiens
  Cancerous prostate
  SIGNAL -40..-1: Von Heijne matrix
  score 9.00
  seq LLCLLHFSIVSVA/AX
  UNSURE 8: Xaa =  * ,Cys,Arg,Ser
  UNSURE 7: Xaa = Ala,Cys,Gly,Ser,Thr
  UNSURE 11: Xaa = Ala,Glu
  UNSURE 2: Xaa = Asp,His
  UNSURE 6: Xaa = Cys,Phe,Gly,Val
  UNSURE 9,15: Xaa = Phe,Leu
  UNSURE 5: Xaa = Pro,Ser
MGSKVADLLYWKDTRTSGVVFTGLMVSLLCLLHFSIVSVAAXFGXXXXXGXQSSXRVYAKCCRPCTGGME

SEQ ID NO: 2084 - protein, 69 aa, Homo Sapiens
  Hypertrophic prostate
  SIGNAL -29..-1: Von Heijne matrix; score 8.90; seq ALLIVCDVPSASA/QR
MAARWRFWCVSVTMVVALLIVCDVPSASAQRKKEMVLSEKVSQLMEWTNKRPVIRMNGDKFRRLVKPHM

SEQ ID NO: 2085 - protein, 137 aa, Homo Sapiens
  Umbilical cord
  SIGNAL -19..-1: Von Heijne matrix; score 8.80; seq SAVLSGFVLGALA/FQ
MEGESTSAVLSGFVLGALAFQHLNTDSDTEGFLLGEVKGEAKNSITDSQMDDVEVVYTIDIQKYIPCYQLFSFYNSSGEVNEQALKKILSNVKKNVVGWYKFRRHSDQIMTFRERLLHKNLQEHFSNQDLVFLLLTP

SEQ ID NO: 2086 - protein, 52 aa, Homo Sapiens
  Hypertrophic prostate
  SIGNAL -32..-1: Von Heijne matrix; score 8.80; seq VPMLLLIVGGSFG/LR
MFAPAVMRAFRKNKTLGYGVPMLLLIVGGSFGLREFSQIRYDAVKSKMDPER

SEQ ID NO: 2087 - protein, 139 aa, Homo Sapiens
  Lymph ganglia
  SIGNAL -136..-1: Von Heijne matrix
  score 8.70
  seq AVALSLFLGWLGA/DR
  UNSURE -131: Xaa = Pro,Arg
MAAAWXSGPSAPEAVTARLVGVLWFVSVTTGPWGAVATSAGGEESLKCEDLKVGQYICKDPKINDATQEPVNCTNYTAHVSCFPAPNITCKDSSGNETHFTGNEVGFFKPISCRNVNGYSYKVAVALSLFLGWLGADRF

SEQ ID NO: 2088 - protein, 32 aa, Homo Sapiens
  Normal prostate
  SIGNAL -19..-1: Von Heijne matrix; score 8.60; seq LLWLALACSPVHT/TL
MRTLFNLLWLALACSPVHTTLSKSDAKKATSG

SEQ ID NO: 2089 - protein, 91 aa, Homo Sapiens
  Brain
  SIGNAL -42..-1: Von Heijne matrix; score 8.60; seq ASLFLLLSLTVFS/IV
MDGQKKNWKDKVVDLLYWRDIKKTGVVFGASLFLLLSLTVFSIVSVTAYIALALLSVTISFRIYKGVIQAIQKSDEGHPFRAYLESEVAIS

SEQ ID NO: 2090 - protein, 145 aa, Homo Sapiens
  Umbilical cord
  SIGNAL -18..-1: Von Heijne matrix
  score 8.50
  seq LVLGLVLPLILWA/DR
  UNSURE 76: Xaa = Ala,Pro
  UNSURE 124: Xaa = Leu,Val
MVAPGLVLGLVLPLILWADRSAGIGFRFASYINNDMVLQKEPAGAVIWGFGTPGATVTVTLRQGQETIMKKVTSVKAHSDTWMVVLDPMKPGGXFEVMAQQTLEKINFTLRVHDVLFGDVWLCSGQSNMQMTARVFRWRHVXGLL

SEQ ID NO: 2091 - protein, 93 aa, Homo Sapiens
  Ovary
  SIGNAL -21..-1: Von Heijne matrix; score 8.50; seq LLTIVGLILPTRG/QT
MSPSGRLCLLTIVGLILPTRGQTLKDTTSSSSADSTIMDIQVPTRAPDAVYTELQPTSPTPTWPADETPQPQTQTQQLEGTDGPLVTDPETPR

SEQ ID NO: 2092 - protein, 114 aa, Homo Sapiens
  Prostate
  SIGNAL -47..-1: Von Heijne matrix; score 8.30; seq LALSSLLSLLLFA/GM
MRIANRTRFSLPFLARGAGWTHGRGMMVVGTGTSLALSSLLSLLLFAGMQMYSRQLASTEWLTIQGGLLGSGLFVFSLTAFNNLENLVFGKGFQAKIFPEILLCLLLALFASGP

SEQ ID NO: 2093 - protein, 86 aa, Homo Sapiens
  Normal prostate
  SIGNAL -35..-1: Von Heijne matrix
  score 8.30
  seq NLLLLHCVSRSHS/QN
  UNSURE 38: Xaa =  * ,Cys
MVLGGCPVSYLLLCGQAALLLGNLLLLHCVSRSHSQNATAEPELTSAGAAQPEGPGGAASWEYGDPHSPVILXSYLPDEFIECEDR

SEQ ID NO: 2094 - protein, 125 aa, Homo Sapiens
  brain
  SIGNAL -53..-1: Von Heijne matrix
  score 8.10
  seq IYALFLLVGVCVA/CV
  UNSURE 47: Xaa = Phe,Ile,Leu
MGSVLGLCSMASWIPCLCGSAPCLLCRCCPSGNNSTVTRLIYALFLLVGVCVACVMLIPGMEEQLNKIPGFCENEKGVVPCNILVGYKAVYRLCFGLAMXYLLLSLLMIKVKSSSDPRAAVHNGF

SEQ ID NO: 2095 - protein, 155 aa, Homo Sapiens
  Brain
  SIGNAL -57..-1: Von Heijne matrix
  score 8.00
  seq IVRLVAFCPFASS/QV
  UNSURE 67: Xaa = Gly,Arg
  UNSURE 83: Xaa = Gly,Val
MVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRXVRLHFHNLVKGSDRCXQLVKHSWGWDTAIPM

SEQ ID NO: 2096 - protein, 62 aa, Homo Sapiens
  Colon
  SIGNAL -47..-1: Von Heijne matrix; score 7.90; seq LLLPRVLLTMASG/SP
MSGGRAPAVLLGGVASLLLSFVWMPALLPVASRLLLLPRVLLTMASGSPPTQPSPASDSGIG

SEQ ID NO: 2097 - protein, 42 aa, Homo Sapiens
  Brain
  SIGNAL -26..-1: Von Heijne matrix; score 7.80; seq LVGFILFLTRSRG/RA
MVAPVWYLVAAALLVGFILFLTRSRGRAASAGQEPLHNEEPG

SEQ ID NO: 2098 - protein, 131 aa, Homo Sapiens
  Brain
  SIGNAL -48..-1: Von Heijne matrix
  score 7.60
  seq FLLVRKLPPLCHG/LP
  UNSURE 5: Xaa = Arg,Ser
MAVLAPLIALVYSVPRLSRWLAQPYYLLSALLSAAFLLVRKLPPLCHGLPTQXEDGNPCDFDWREVEILMFLSAIVMMKNRRSITVEQHIGNIFMFSKVANTILFFRLDIRMGLLYITLCIVFLMTCKPPL

SEQ ID NO: 2099 - protein, 148 aa, Homo Sapiens
  Testis
  SIGNAL -69..-1: Von Heijne matrix
  score 7.60
  seq FLLVRKLPPLCHG/LP
  UNSURE -56: Xaa = Ala,Pro
  UNSURE -50: Xaa = Asp,Glu,Gly,Val
  UNSURE -55: Xaa = Leu,Val
MVGEAGRDLRRRRXXAVTAXKMAVLAPLIALVYSVPRLSRWLAQPYYLLSALLSAAFLLVRKLPPLCHGLPTQREDGNPCDFDWREVEILMFLSAIVMMKNRRSITVEQHIANIFMFSKVANTILFFRLDIRMGLLYITLCIVFLMTC

SEQ ID NO: 2100 - protein, 139 aa, Homo Sapiens
  Brain
  SIGNAL -48..-1: Von Heijne matrix; score 7.60; seq LLMLLLFLSELQY/YL
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDP

SEQ ID NO: 2101 - protein, 144 aa, Homo Sapiens
  Substantia nigra
  SIGNAL -48..-1: Von Heijne matrix
  score 7.60
  seq FLLVRKLPPLCHG/LP
  UNSURE 68: Xaa = Cys,Tyr
  UNSURE 10: Xaa = His,Leu,Pro,Gln,Arg
  UNSURE 91: Xaa = Lys,Arg,Thr
MAVLAPLIALVYSVPRLSRWLAQPYYLLSALLSAAFLLVRKLPPLCHGLPTQREDGNXCDFDWREVEILMFLSAIVMMKNRRSITVEQHIGNIFMFSKVANTILFFRLDIRMGLLXITLCIVFLMTCKPPLYMGPEYIXYFNDK

SEQ ID NO: 2102 - protein, 117 aa, Homo Sapiens
  Testis
  SIGNAL -19..-1: Von Heijne matrix; score 7.40; seq PMLLRALAQAARA/GP
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLC

SEQ ID NO: 2103 - protein, 131 aa, Homo Sapiens
  Brain
  SIGNAL -19..-1: Von Heijne matrix
  score 7.40
  seq PMLLRALAQAARA/GP
  UNSURE 61: Xaa = Ala,Pro,Ser,Thr
MRCLTTPMLLRALAQAARAGPPGGRSLHSSAVAATYKYVNMQDPEMDMKSVTDRAARTLLWTELFRGLGMTLSYLFREPXTINYPFEKGPLSPRFRGEHALRRYPSGEERCIACKLCEAICPAQAITIEAE

SEQ ID NO: 2104 - protein, 116 aa, Homo Sapiens
  Substantia nigra
  SIGNAL -21..-1: Von Heijne matrix
  score 7.40
  seq ILPLLFGCLGVFG/LF
  UNSURE 77: Xaa = Leu,Arg
  UNSURE 78: Xaa = Phe,Leu
MDFITSTAILPLLFGCLGVFGLFRLLQWVRGKAYLRNAVVVITGATSGLGKECAKVFYAAGAKLVLCGRNGGALEELIRELTASHATKVQTHKPYLVXXDLTDSGAIVAAAAEICS

SEQ ID NO: 2105 - protein, 47 aa, Homo Sapiens
  Lymph ganglia
  SIGNAL -29..-1: Von Heijne matrix
  score 7.40
  seq LLLVTWVFTPVTT/EI
  UNSURE 9: Xaa = Gly,Arg,Ser
MHPAVFLSLPDLRCSLLLLVTWVFTPVTTEITSLDTEXIDEILNNAL

SEQ ID NO: 2106 - protein, 63 aa, Homo Sapiens
  Brain
  SIGNAL -20..-1: Von Heijne matrix; score 7.40; seq LVFCVGLLTMAKA/ES
MASLGHILVFCVGLLTMAKAESPKEHDPFTYDYQSLQIGGLVIAGILFILGILIVLSRRCRFR

SEQ ID NO: 2107 - protein, 138 aa, Homo Sapiens
  Spleen
  SIGNAL -23..-1: Von Heijne matrix
  score 7.30
  seq ALSLLLVSGSLLP/GP
  UNSURE 108: Xaa =  * ,Glu,Lys
MSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSXNKNEGQD

SEQ ID NO: 2108 - protein, 96 aa, Homo Sapiens
  Lymph ganglia
  SIGNAL -36..-1: Von Heijne matrix; score 7.20; seq IMLLSLAAFSVIS/VV
MAVHDLIFWRDVKKTGFVFGTTLIMLLSLAAFSVISVVSYLILALLSVTISFRIYKSVIQAVQKSEEGHPFKAYLDVDITLSSEAFHNYMNAAMVH

SEQ ID NO: 2109 - protein, 90 aa, Homo Sapiens
  Lymph ganglia
  SIGNAL -32..-1: Von Heijne matrix
  score 7.10
  seq LLWTLLLFAAPFG/LL
  UNSURE -24: Xaa =  * ,Trp
  UNSURE -31: Xaa = His,Arg
MXGSVECTXGWGHCAPSPLLLWTLLLFAAPFGLLGEKTRQVSLEVIPNWLGPLQNLLHIRAVGTNSTLHYVWSSLGPLAVVMVATNTPPG

SEQ ID NO: 2110 - protein, 97 aa, Homo Sapiens
  Normal prostate
  SIGNAL -29..-1: Von Heijne matrix
  score 7.10
  seq LIFLCGAALLAVG/IW
  UNSURE 51: Xaa = Ala,Thr
  UNSURE 53: Xaa = Asn,Ser
  UNSURE 47: Xaa = Asn,Ser,Thr,Tyr
MQCFSFIKTMMILFNLLIFLCGAALLAVGIWVSIDGASFLKIFGPLSSSAMQFVNVGYFLIAAGVVVFALGFLGCXGAKXEXKCALVTFFFILLLIF

SEQ ID NO: 2111 - protein, 120 aa, Homo Sapiens
  Testis
  SIGNAL -32..-1: Von Heijne matrix
  score 7.10
  seq LLWTLLLFAAPFG/LL
  UNSURE 29: Xaa = Ala,Pro,Ser
  UNSURE -22: Xaa = Ser,Trp
MRGSVECTWGXGHCAPSPLLLWTLLLFAAPFGLLGEKTHQVSLEVIPNWLGPLQNLLHIRXVGTNSTLHYVWSSLGPLAVVMVATNTPHSTLSVNWSLLLSPEPDGGLMVLPKDSIQFSS

SEQ ID NO: 2112 - protein, 66 aa, Homo Sapiens
  Lymphocytes
  SIGNAL -15..-1: Von Heijne matrix; score 7.00; seq LRLLKLAATSASA/RV
MALRLLKLAATSASARVVAAGAQRVRGIHSSVQCKLRYGMWHFLLGDKASKRLTERSRVITVDGNM

SEQ ID NO: 2113 - protein, 116 aa, Homo Sapiens
  Cancerous prostate
  SIGNAL -65..-1: Von Heijne matrix; score 7.00; seq IGHFLCLVILVYC/AE
MPSAFSVSSFPVSIPAVLTQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKT

SEQ ID NO: 2114 - protein, 163 aa, Homo Sapiens
  Testis
  SIGNAL -154..-1: Von Heijne matrix
  score 6.70
  seq ALGILVVAGCSFA/IR
  UNSURE -126: Xaa =  * ,Gly,Arg
MALPHQEPKPGDLIEIFRLGYEHWALYIXDGYVIHLAPPSEYPGAGSSSVFSVLSNSAEVKRERLEDVVGGCCYRVNNSLDHEYQPRPVEVIISSAKEMVGQKMKYSIVSRNCEHFVTQLRYGKSRCKQVEKAKVEVGVATALGILVVAGCSFAIRRYQKKAT

SEQ ID NO: 2115 - protein, 125 aa, Homo Sapiens
  Hypertrophic prostate
  SIGNAL -70..-1: Von Heijne matrix
  score 6.70
  seq LAFSLPALPLAEL/QP
  UNSURE 43: Xaa =  * ,Lys
MAASTSMVPVAVTAAVAPVLSINSDFSDLREIKKQLLLIAGLTRERGLLHSSKWSAELAFSLPALPLAELQPPPPITEEDAQDMDAYTLAKAYFDVKEYDRAAHFLHGCNARXAYFLYMYSRYLS

SEQ ID NO: 2116 - protein, 94 aa, Homo Sapiens
  Hypertrophic prostate
  SIGNAL -24..-1: Von Heijne matrix
  score 6.60
  seq KMVHLLVLSGAWG/MQ
  UNSURE 45: Xaa = Phe,Ile,Leu,Val
MEEGGNLGGLIKMVHLLVLSGAWGMQMWVTFVSGFLLFRSLPRHTFGLVQSKLFPFYFHISMGCAFINXCILASQHAWAQLTFWEASQLYLLFL

SEQ ID NO: 2117 - protein, 87 aa, Homo Sapiens
  kidney
  SIGNAL -81..-1: Von Heijne matrix
  score 6.60
  seq LLLASGTTLFCTS/FY
  UNSURE -51: Xaa =  * ,Glu,Gln
MAGPAAAFRRLGALSGAAALGFASYGAHGAXFPDAYGKELFDKANKHHFLHSLALLGVPHCRKPLWAGLLLASGTTLFCTSFYYQAQ

SEQ ID NO: 2118 - protein, 46 aa, Homo Sapiens
  Testis
  SIGNAL -21..-1: Von Heijne matrix; score 6.50; seq LLTLLLPPPPLYT/RH
MGHRFLRGLLTLLLPPPPLYTRHRMLGPESVPPPKRSRSKLMAPPR

SEQ ID NO: 2119 - protein, 80 aa, Homo Sapiens
  kidney
  SIGNAL -20..-1: Von Heijne matrix
  score 6.50
  seq ILFLLPSICSSNS/TG
  UNSURE 59: Xaa = Ala,Pro,Thr
  UNSURE 41: Xaa = His,Leu,Pro
  UNSURE 17: Xaa = Lys,Asn
MELLQVTILFLLPSICSSNSTGVLEAANNSLVVTTTXPSITTPNTESLQKNVVTPTTGTTXKGTITNELLKMSLMSTAXF

SEQ ID NO: 2120 - protein, 117 aa, Homo Sapiens
  Lung (cells)
  SIGNAL -19..-1: Von Heijne matrix; score 6.30; seq VLMRLVASAYSIA/QK
MASSNTVLMRLVASAYSIAQKAGMIVRRVIAEGDLGIVEKTCATDLQTKADRLAQMSICSSLARKFPKLTIIGEEDLPSEEVDQELIEDSQWEEILKQPCPSQYSAIKEEDLVVWVD

SEQ ID NO: 2121 - protein, 117 aa, Homo Sapiens
  Brain
  SIGNAL -15..-1: Von Heijne matrix
  score 6.30
  seq SSCVLLTALVALA/AY
  UNSURE 100: Xaa = Gly,Arg
MRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGXGW

SEQ ID NO: 2122 - protein, 74 aa, Homo Sapiens
  brain
  SIGNAL -26..-1: Von Heijne matrix; score 6.30; seq GVGLVTLLGLAVG/SY
MGIQTSPVLLASLGVGLVTLLGLAVGSYLVRRSRRPQVTLLDPNEKYLLRLLDKTTVSHNTKRFRFALPTAHHM

SEQ ID NO: 2123 - protein, 88 aa, Homo Sapiens
  brain
  SIGNAL -69..-1: Von Heijne matrix; score 6.30; seq ILLIVLFLDAVRE/VR
MTLQWAAVATFLYAEIGLILIFCLPFIPPQRWQKIFSFNVWGKIATFWNKAFLTIIILLIVLFLDAVREVRKYSSVHTIEKSSTSRPR

SEQ ID NO: 2124 - protein, 94 aa, Homo Sapiens
  kidney
  SIGNAL -85..-1: Von Heijne matrix; score 6.20; seq FLDFCVYIPLSWG/FC
MPSEGRCWETLKALRSSDKGRLCYYRDWLLRREVSGGPGGRRPFRPLATETFSLAVGTFCSREPVQSNNLHLFLDFCVYIPLSWGFCPLQPILA

SEQ ID NO: 2125 - protein, 113 aa, Homo Sapiens
  Umbilical cord
  SIGNAL -24..-1: Von Heijne matrix
  score 6.20
  seq AILGSTWVALTTG/AL
  UNSURE 64: Xaa = Lys,Met,Arg,Thr
  UNSURE 72: Xaa = Ser,Thr
MTKLAQWLWGLAILGSTWVALTTGALGLELPLSCQEVLWPLPAYLLVSAGCYALGTVGYRVATFHDCEDAARELQSQIQEARADLARXGCASDSLXPFLCGQPFLPFPIKEPG

SEQ ID NO: 2126 - protein, 55 aa, Homo Sapiens
  Normal prostate
  SIGNAL -21..-1: Von Heijne matrix; score 6.20; seq FLVSNMLLAEAYG/SG
MLLAWVQAFLVSNMLLAEAYGSGGCFWDNGHLYREDQTSPAPGLRCLNWLDAQSG

SEQ ID NO: 2127 - protein, 126 aa, Homo Sapiens
  Brain
  SIGNAL -41..-1: Von Heijne matrix; score 6.20; seq SVLVLLLLAVLYE/GI
MAMHFIFSDTAVLLFHFWSVHSPAGMALSVLVLLLLAVLYEGIKVGKAKLLNQVLVNLPTSISQQTIAETDGDSAGSDSFPVGRTHHRWYLCHFGQSLIHVIQVVIGYFIMLAVMSYNTWIFLGVV

SEQ ID NO: 2128 - protein, 78 aa, Homo Sapiens
  Normal prostate
  SIGNAL -75..-1: Von Heijne matrix
  score 6.20
  seq VVXXSVLXTTCXS/SQ
  UNSURE -11: Xaa =  * ,Leu,Trp
  UNSURE -2: Xaa = Asn,Thr
  UNSURE -24: Xaa = Cys,Ser
  UNSURE -14: Xaa = Lys,Thr
  UNSURE -6: Xaa = Met,Val
  UNSURE -10: Xaa = Pro,Thr
MKQVHQCIERCHVPLAQAQALVTSELEKFQDRLARCTMHCNDKAKDSIDAGXKELQVKQQLXVVXXSVLXTTCXSSQL

SEQ ID NO: 2129 - protein, 39 aa, Homo Sapiens
  Brain
  SIGNAL -27..-1: Von Heijne matrix; score 6.20; seq LLAALMLVAMLQL/LY
MQMSYAIRCAFYQLLLAALMLVAMLQLLYLSLLSGLHGP

SEQ ID NO: 2130 - protein, 60 aa, Homo Sapiens
  Umbilical cord
  SIGNAL -19..-1: Von Heijne matrix; score 6.10; seq IILLIHTMQVCTT/HP
MMTQTCIILLIHTMQVCTTHPTVLSHTLLQRPKPTDLFPKATPTTAPMPLRMRPPQCLPE

SEQ ID NO: 2131 - protein, 39 aa, Homo Sapiens
  kidney
  SIGNAL -22..-1: Von Heijne matrix
  score 6.10
  seq LFLTCLFWPLAAL/NV
  UNSURE -20: Xaa = Asp,Asn,Tyr
  UNSURE -21: Xaa = His,Gln,Arg
MXXHLQTRPLFLTCLFWPLAALNVNSTFECLILQCSVGI

SEQ ID NO: 2132 - protein, 92 aa, Homo Sapiens
  Testis
  SIGNAL -52..-1: Von Heijne matrix
  score 6.10
  seq LMAFLLSFYLIFT/NE
  UNSURE -44: Xaa = Asn,Ser
  UNSURE 35: Xaa = Lys,Met,Arg,Thr
MAANYSSTXTRREHVKVKTSSQPGFLERLSETSGGMFVGLMAFLLSFYLIFTNEGRALKTATSLAEGLSLVVSPDSIHSVAPENEGXLVHII

SEQ ID NO: 2133 - protein, 26 aa, Homo Sapiens
  Cancerous prostate
  SIGNAL -21..-1: Von Heijne matrix; score 6.10; seq LEMLTAFASHIRA/RD
MRGAHLTALEMLTAFASHIRARDASG

SEQ ID NO: 2134 - protein, 50 aa, Homo Sapiens
  Cancerous prostate
  SIGNAL -24..-1: Von Heijne matrix; score 6.10; seq IILLIHTMQVCTT/HP
MVHKPMMTQTCIILLIHTMQVCTTHPTVLSHTLLQRPKPTDLFPKATPTT

SEQ ID NO: 2135 - protein, 36 aa, Homo Sapiens
  Cancerous prostate
  SIGNAL -28..-1: Von Heijne matrix; score 6.00; seq IGLMFLMLGCALP/IY
MAGIKALISLSFGGAIGLMFLMLGCALPIYNKYWPT

SEQ ID NO: 2136 - protein, 88 aa, Homo Sapiens
  Normal prostate
  SIGNAL -21..-1: Von Heijne matrix; score 6.00; seq LLFPLTLVRSFWS/DM
MSLMPKMHLLFPLTLVRSFWSDMMDSAQSFITSSWTFYLQADDGKIVIFQSKPEIQYAPHLEQEPTNLRESSLSKMSYLQMRNSQAHR

SEQ ID NO: 2137 - protein, 115 aa, Homo Sapiens
  Lung
  SIGNAL -87..-1: Von Heijne matrix
  score 5.90
  seq SNILLASVGSVLG/AC
  UNSURE 18: Xaa =  * ,Glu,Lys
  UNSURE 9: Xaa = Ala,Ser
  UNSURE 16: Xaa = Asp,Glu
  UNSURE 17: Xaa = Gly,Val
MMKRAAAAAVGGALAVGAVPVVLSAMGFTGAGIAASSIAAKMMSAAAIANGGGVSAGSLVATLQSVGAAGLSTSSNILLASVGSVLGACLGNSPSXSLPAEPXXXEDEARENVPP

SEQ ID NO: 2138 - protein, 32 aa, Homo Sapiens
  Normal prostate
  SIGNAL -14..-1: Von Heijne matrix
  score 5.80
  seq VTIILLLSCXFWA/VK
  UNSURE -4: Xaa = Asp,Gly
  UNSURE 6: Xaa = Cys,Gly
  UNSURE 8: Xaa = Gly,Leu,Arg,Val
MVTIILLLSCXFWAVKNVTXRXMVGLRWWNHI

SEQ ID NO: 2139 - protein, 130 aa, Homo Sapiens
  Lung
  SIGNAL -87..-1: Von Heijne matrix
  score 5.80
  seq SNILLASVGSVSG/AC
  UNSURE -86: Xaa = Ile,Lys,Met
MXKRAAAAAVGGALAVGAVPVVLSAMGFTGAGIAASSIAAKMMSAAAIANGGGVSAGSLVATLQSVGAAGLSTSSNILLASVGSVSGACLGNSPSSSLPAEPEAKEDEARENVPQGEPPKPPLKSEKHER

SEQ ID NO: 2140 - protein, 118 aa, Homo Sapiens
  Normal prostate
  SIGNAL -89..-1: Von Heijne matrix
  score 5.70
  seq DLSLLSLPPGTSP/VG
  UNSURE -61: Xaa = Ala,Pro
  UNSURE -83,14,17: Xaa = Leu,Val
  UNSURE -62: Xaa = Phe,Leu
  UNSURE 19: Xaa = Pro,Thr
MSQDGGXGELKHMVMSFRVSELQVLLGXXGRNKSGRKHELLAKALHLLKSSCAPSVQMKIKELYRRRFPRKTLGPSDLSLLSLPPGTSPVGSPGPLAPIPPTXLAXAXCWAPSVRWTC

SEQ ID NO: 2141 - protein, 46 aa, Homo Sapiens
  Spleen
  SIGNAL -24..-1: Von Heijne matrix
  score 5.70
  seq LLLPRVLLTMASG/SL
  UNSURE 13,19: Xaa = Ala,Asp
  UNSURE -22: Xaa = Ala,Glu
  UNSURE 6: Xaa = Ala,Pro,Thr
  UNSURE 4: Xaa = Leu,Pro
MPXLLPVASRLLLLPRVLLTMASGSLRXSXRRPRIPXLATFRXRSL

SEQ ID NO: 2142 - protein, 122 aa, Homo Sapiens
  kidney
  SIGNAL -35..-1: Von Heijne matrix
  score 5.70
  seq IFSFLDIVTLCRC/AQ
  UNSURE 58,84: Xaa = Asp,Gly
  UNSURE 62: Xaa = Glu,Lys
  UNSURE 4: Xaa = Phe,Leu,Ser
MVFSNNDEGLINKKLPKELLLRIFSFLDIVTLCRCAQIXKAWNILALDGSNWQRIDLFNFQTDVEGRVVENISKRCGGFLRKLSLRGCIGVGXSSLXTFAQNCRNIEHLNLNGCTKITXSTC

SEQ ID NO: 2143 - protein, 54 aa, Homo Sapiens
  Brain
  SIGNAL -35..-1: Von Heijne matrix; score 5.70; seq IFSFLDIVTLCRC/AQ
MVFSNNDEGLINKKLPKELLLRIFSFLDIVTLCRCAQISKAWNILALDGSNWQG

SEQ ID NO: 2144 - protein, 145 aa, Homo Sapiens
  Umbilical cord
  SIGNAL -112..-1: Von Heijne matrix
  score 5.60
  seq SSCILPWLSKTNS/CP
  UNSURE 33: Xaa = Gly,Arg,Trp
MASYFDEHDCEPSDPEQETRTNMLLELARSLFNRMDFEDLGLVVDWDHHLPPPAAKTVVENLPRTVIRGSQAELKCPVCLLEFEEEETAIEMPCHHLFHSSCILPWLSKTNSCPLCRYELPTDDDTYEEHRRDKARKQQQQHRPX

SEQ ID NO: 2145 - protein, 66 aa, Homo Sapiens
  Lymph ganglia
  SIGNAL -15..-1: Von Heijne matrix
  score 5.60
  seq LILSLQVCRPATL/DQ
  UNSURE 38: Xaa = Ala,Pro
MPLILSLQVCRPATLDQATRATTPCRLSQGCQQHPTQCSTHHLTQPSPWAHRXTTRPWLEEQPRPG

SEQ ID NO: 2146 - protein, 76 aa, Homo Sapiens
  Surrenals
  SIGNAL -73..-1: Von Heijne matrix; score 5.60; seq LRRLLGCLTLTLS/GR
MLGITSCSDQQAKEGEGLEGSSTGSSSGNHGGSGGGNGHKPGCEKPGNEARGSGNLGFRTLRRLLGCLTLTLSGRI

SEQ ID NO: 2147 - protein, 91 aa, Homo Sapiens
  Brain
  SIGNAL -17..-1: Von Heijne matrix
  score 5.60
  seq ALKLASWTSMALA/AS
  UNSURE 67: Xaa =  * ,Glu,Lys,Gln
  UNSURE 34: Xaa = Asp,Tyr
  UNSURE 68: Xaa = Leu,Val
MARKALKLASWTSMALAASGIYFYSNKYLDPNDFGAVRVGRAVATTAVISXDYLTSLKSVPYGSEEYLQLRSKVHLRSARRLCXXCCANRG

SEQ ID NO: 2148 - protein, 132 aa, Homo Sapiens
  Normal prostate
  SIGNAL -16..-1: Von Heijne matrix
  score 5.60
  seq AALPAWLSLQSRA/RS
  UNSURE 108: Xaa = Ala,Glu,Gly,Val
  UNSURE 33: Xaa = Arg,Ser
  UNSURE 60: Xaa = Phe,Leu
MAAAALPAWLSLQSRARSLRAFSTAVYSATPVPTPSLPERTPGNERPPXRKALPPRTEKMAVDQDWPSVYPVAAPXKPSAVPLPVRMGYPVKKGVPMAKEGNLELLKIPNFLHLTPVAIKKHCXALKDFCTE

SEQ ID NO: 2149 - protein, 112 aa, Homo Sapiens
  Substantia nigra
  SIGNAL -65..-1: Von Heijne matrix
  score 5.60
  seq CMLTLXXLSFILA/GL
  UNSURE 23: Xaa =  * ,Glu,Lys,Gln
  UNSURE -7: Xaa = Ala,Cys,Asp,Gly,His,Asn,Pro,Arg,Ser,Thr,Tyr
  UNSURE -8: Xaa = Phe,Leu
MVKIAFNTPTAVQKEEARQDVEALLSRTVRTQILTGKELRVATQEKEGSSGRCMLTLXXLSFILAGLIVGGACIYKYFMPKSTIYRGXMCFFDSEDPANSLRGGEPNFLPVT

SEQ ID NO: 2150 - protein, 59 aa, Homo Sapiens
  Thyroid
  SIGNAL -48..-1: Von Heijne matrix
  score 5.60
  seq LLLSFVWMPALLP/DG
  UNSURE -24: Xaa = Phe,Ile
MIGSGLAGSGGAGGPSSTVTWCALXSNHVAATQASLLLSFVWMPALLPDGLPPFVATPM

SEQ ID NO: 2151 - protein, 52 aa, Homo Sapiens
  Lung (cells)
  SIGNAL -18..-1: Von Heijne matrix
  score 5.60
  seq LXGFLFXVIVLTS/WI
  UNSURE -7: Xaa = Cys,Trp
  UNSURE -12: Xaa = Leu,Met
MSGAQLXGFLFXVIVLTSWITIFQIYRPRWGCPWGLPLLHIPLGTPDNFCTY

SEQ ID NO: 2152 - protein, 82 aa, Homo Sapiens
  Placenta
  SIGNAL -29..-1: Von Heijne matrix; score 5.60; seq VVFMTVAASGASS/FA
MSFFQLLMKRKELIPLVVFMTVAASGASSFAVYSLWKTDVILDRKKNPEPWETVDPTVPQKLITINQQWKPIEELQNVQRVT

SEQ ID NO: 2153 - protein, 68 aa, Homo Sapiens
  Lung (cells)
  SIGNAL -15..-1: Von Heijne matrix; score 5.50; seq LAHSLLLNEEALA/QI
MELAHSLLLNEEALAQITEAKRPVFIFEWLRFLDKVLVAANKTDVKEKQKKLVEQLTGLISSSPGPTG

SEQ ID NO: 2154 - protein, 90 aa, Homo Sapiens
  Prostate
  SIGNAL -28..-1: Von Heijne matrix; score 5.50; seq LGYLVLSEGAVLA/SS
MTSALTQGLERIPDQLGYLVLSEGAVLASSGDLENDEQAASAISELVSTACGFRLHRGMNVPFKRLSVVFGEHTLLVTVSGQRVFVVKRG

SEQ ID NO: 2155 - protein, 148 aa, Homo Sapiens
  Brain
  SIGNAL -31..-1: Von Heijne matrix
  score 5.50
  seq LVGVLWFVSVTTG/PW
  UNSURE 94: Xaa =  * ,Cys,Phe,Leu,Ser,Trp,Tyr
  UNSURE 92: Xaa =  * ,Glu
  UNSURE 91: Xaa = Ala,Cys,Asp,Phe,Gly,His,Ile,Leu,Asn,Pro,Arg,Ser,Thr,Val,Tyr
  UNSURE 62: Xaa = Ala,Pro,Ser,Thr
  UNSURE -22: Xaa = Ala,Ser
  UNSURE 95: Xaa = Asp,Phe,His,Ile,Leu,Asn,Val,Tyr
MAAAWPSGPXAPEAVTARLVGVLWFVSVTTGPWGAVATSAGGEESLKCEDLKVGQYICKDPKINDATQEPVNCTNYTAHVSCFPAPNITCKDXSGNETHFTGNEVGFFKPISCRNVNGYSYXXQXXVSFSWMVGSRSILPWIPCFGFV

SEQ ID NO: 2156 - protein, 28 aa, Homo Sapiens
  Cancerous prostate
  SIGNAL -13..-1: Von Heijne matrix; score 5.50; seq MVLLTMIARVADG/LP
MVLLTMIARVADGLPLAASMQEDEQSGR

SEQ ID NO: 2157 - protein, 98 aa, Homo Sapiens
  Lung (cells)
  SIGNAL -13..-1: Von Heijne matrix; score 5.50; seq MVLLTMIARVADG/LP
MVLLTMIARVADGLPLAASMQEDEQSGRDLQQYQSQAKQLFRKLNEQSPTRCTLEAGAMTFHYIIEQGVCYLVLCEAAFPKKLAFAYLEDLHSEFDEQ

SEQ ID NO: 2158 - protein, 103 aa, Homo Sapiens
  Muscle
  SIGNAL -69..-1: Von Heijne matrix
  score 5.40
  seq MMVLSLGIXLASA/SF
  UNSURE -5: Xaa = Ile,Ser
MTSQPVPNETIIVLPSNVINFSQAEKPEPTNQGQDSLKKHLHAEIKVIGTIQILCGMMVLSLGIXLASASFSPNFTQVTSTLLNSAYPFIGPFFFIISGSLSI

SEQ ID NO: 2159 - protein, 135 aa, Homo Sapiens
  Placenta
  SIGNAL -25..-1: Von Heijne matrix
  score 5.30
  seq AVTSLLSPTPATA/LA
  UNSURE 61: Xaa = Ala,Asp,Gly,His,Ile,Leu,Asn,Pro,Arg,Ser,Thr,Val
  UNSURE 90: Xaa = Asp,Gly
  UNSURE 96: Xaa = Phe,Ile,Leu,Pro,Ser,Thr
MASVVLALRTRTAVTSLLSPTPATALAVRYASKKSGGSSKNLGGKSSGRRQGIKKMEGHYVHAGNIIATQRHFRWHPGAHVGVGKXKCLYALEEGIVRYTKEVYVPHPRNTEAVXLITRLXKGAVLYKTFVTWFL

SEQ ID NO: 2160 - protein, 135 aa, Homo Sapiens
  Substantia nigra
  SIGNAL -25..-1: Von Heijne matrix
  score 5.30
  seq AVTSLLSPTPATA/LA
  UNSURE 72: Xaa = Asp,His,Ile,Leu,Asn,Val
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIXRYTKEVYVPHPRNTEAVDLITRLPKGAVLYKTFVHVVP

SEQ ID NO: 2161 - protein, 96 aa, Homo Sapiens
  Brain
  SIGNAL -57..-1: Von Heijne matrix; score 5.30; seq AIALATVLFLIGA/FL
MMPSRTNLATGIPSSKVKYSRLSSTDDGYIDLQFKKTPPKIPYKAIALATVLFLIGAFLIIIGSLLLSGYISKGGADRAVPVLIIGILVFLPGFYH

SEQ ID NO: 2162 - protein, 38 aa, Homo Sapiens
  Testis
  SIGNAL -15..-1: Von Heijne matrix
  score 5.60
  seq LILSLQVCRPATL/DQ
  UNSURE 22: Xaa = Asp,His,Asn,Tyr
MPLILSLQVCRPATLDQATRATTPCRLSQGCQQHPTXQ

SEQ ID NO: 2163 - protein, 43 aa, Homo Sapiens
  Testis
  SIGNAL -15..-1: Von Heijne matrix; score 5.60; seq LILSLQVCRPATL/DQ
MPLILSLQVCRPATLDQATRATTPCRLSQGCQQHPTQCSTHLG

SEQ ID NO: 2164 - protein, 81 aa, Homo Sapiens
  Brain
  SIGNAL -68..-1: Von Heijne matrix; score 5.20; seq GVLLLLSSIHFQC/RR
MASSVGNVADSTEPTKRMLSFQGLAELAHREYQAGDFEAAERHCMQLWRQEPDNTGVLLLLSSIHFQCRRLDRSAHFSTLA

SEQ ID NO: 2165 - protein, 110 aa, Homo Sapiens
  Brain
  SIGNAL -94..-1: Von Heijne matrix
  score 5.00
  seq VILQLQFLFDVLQ/KT
  UNSURE -64: Xaa = Phe,Ser
MFGSAPQRPVAMTTAQRDSLLWKLAGLLREXGDVVLSGCSTLSLLTPTLQQLNHVFELHLGPWGPGQTGFVALPSHPADSPVILQLQFLFDVLQKTLSLKLVHVAGPGPT

SEQ ID NO: 2166 - protein, 89 aa, Homo Sapiens
  Brain
  SIGNAL -86..-1: Von Heijne matrix; score 5.00; seq LILVGTSKHVAFG/KI
MSFIFEWIYNGFSSVLQFLGLYKKSGKLVFLGLDNAGKTTLLHMLKDDRLGQHVPTLHPTSEELTIAGMTLQLLILVGTSKHVAFGKII

SEQ ID NO: 2167 - protein, 42 aa, Homo Sapiens
  Cancerous prostate
  SIGNAL -35..-1: Von Heijne matrix; score 5.00; seq WYSTVGLLPPVRA/MS
MDKPCGCPPGVCDHGTGDRRDPWYSTVGLLPPVRAMSQRNLN

SEQ ID NO: 2168 - protein, 134 aa, Homo Sapiens
  Testis
  SIGNAL -36..-1: Von Heijne matrix
  score 5.00
  seq ARALAALVPGVTQ/VD
  UNSURE 68: Xaa = Asp,Glu
  UNSURE 75: Xaa = Lys,Arg
MAAALKCLLTLGRWCPGLGVAPQARALAALVPGVTQVDNKSGFLQKRPHRQHPGILKLPHVRLPQALANGAQLLLLGSAGPTMENQVQTLTSYLWSRHLPVEPXELQRRAXHLEKKFLENPDLSQTEEKLRGAG

SEQ ID NO: 2169 - protein, 117 aa, Homo Sapiens
  Normal prostate
  SIGNAL -102..-1: Von Heijne matrix
  score 4.90
  seq TVMSALSVAPSKA/RE
  UNSURE -18: Xaa = Asn,Ser,Thr
  UNSURE -50: Xaa = Asp,His,Asn,Tyr
MVARVWSLMRFLIKGSVAGGAVYLVYDQELLGPSDKSQAALQKAGEVVPPAMXQFSQYVCQQTGLQIPQLPAPPKIYFPIRDSWXAGIMTVMSALSVAPSKAREYSKEGWEYVKALG

SEQ ID NO: 2170 - protein, 24 aa, Homo Sapiens
  kidney
  SIGNAL -16..-1: Von Heijne matrix
  score 4.90
  seq ELQNLXSLQGSQA/CS
  UNSURE -8: Xaa =  * ,Leu,Ser,Trp
MVNELQNLXSLQGSQACSSSKQRF

SEQ ID NO: 2171 - protein, 54 aa, Homo Sapiens
  Brain
  SIGNAL -24..-1: Von Heijne matrix
  score 4.90
  seq FFFSIQPFLPCSS/RP
  UNSURE 26: Xaa = Ala,Pro,Ser,Thr
MLYMSLKYIRAFFFSIQPFLPCSSRPLKSPSPVAHPTNISVSENAQRCLXTSPW

SEQ ID NO: 2172 - protein, 107 aa, Homo Sapiens
  Cancerous prostate
  SIGNAL -79..-1: Von Heijne matrix
  score 4.90
  seq WVIVLTSWITIFQ/IY
  UNSURE 12: Xaa =  * ,Tyr
MNLERVSNEEKLNLCRKYYLGGFAFLPFLWLVNIFWFFREAFLVPAYTEQSQIKGYVWRSAVGFLFWVIVLTSWITIFQIYRPRWGALGDXLSFTIPLGTPDNFCTY

SEQ ID NO: 2173 - protein, 99 aa, Homo Sapiens
  Normal prostate
  SIGNAL -70..-1: Von Heijne matrix
  score 4.90
  seq LVFVLLFIFVKRQ/IM
  UNSURE -55: Xaa = Ala,Pro
  UNSURE 18: Xaa = Ala,Pro,Ser,Thr
  UNSURE -40: Xaa = Ala,Val
  UNSURE 23: Xaa = Cys,Gly
MAGELQGTQAPSLRGXGLTSQDSGVNPNNSXRGREAMASGSNWLSGVNVVLVMAYGSLVFVLLFIFVKRQIMRFAMKSRRGPHVPVGXQCPQXCYNYLY

SEQ ID NO: 2174 - protein, 82 aa, Homo Sapiens
  Normal prostate
  SIGNAL -56..-1: Von Heijne matrix; score 4.90; seq FACVPGASPTTLA/FP
MTGFLLPPASRGTRRSCSRSRKRQTRRRRNPSSFVASCPTLLPFACVPGASPTTLAFPPVVLTGPSTDGIPFALSLQRVPFV

SEQ ID NO: 2175 - protein, 76 aa, Homo Sapiens
  kidney
  SIGNAL -26..-1: Von Heijne matrix
  score 4.90
  seq VLCTNQVLITARA/VP
  UNSURE 12: Xaa = Ala,Glu
  UNSURE -21: Xaa = Ala,Ser
  UNSURE -23: Xaa = Ile,Leu
MEEXSXPLVEFVKVLCTNQVLITARAVPTKKASVRCVXKRFWIPKTTSKHLSRCIDGISGFLNDFTFCLEFSRHRC

SEQ ID NO: 2176 - protein, 89 aa, Homo Sapiens
  Hypertrophic prostate
  SIGNAL -17..-1: Von Heijne matrix
  score 4.80
  seq LXXVVAFVAPGES/QQ
  UNSURE 59: Xaa = His,Pro,Arg
  UNSURE -11: Xaa = Ile,Asn
  UNSURE -12: Xaa = Pro,Thr
MVRRLXXVVAFVAPGESQQEEPPTDNQDIEPGQEREGTPPIEERKVEGDCQEMDLEKTRSERGDGSDVKEKTPPNXKHAKTKEAGDGPL

SEQ ID NO: 2177 - protein, 149 aa, Homo Sapiens
  Lung (cells)
  SIGNAL -37..-1: Von Heijne matrix
  score 4.80
  seq PIVRLLSCPGTVA/KD
  UNSURE 55: Xaa = Leu,Arg
MAVPGVGLLTRLNLCARRRTRVQRPIVRLLSCPGTVAKDLRRDEQPSGSVETGFEDKIPKRRFSEMQNERREQAQRTVLIHCPEKISENKFXKYLSQFGPINNHFFYESFGLYAVVEFCQKESIGSLQNGTHTPSTAMETAIPFRSRSS

SEQ ID NO: 2178 - protein, 103 aa, Homo Sapiens
  Lymph ganglia
  SIGNAL -60..-1: Von Heijne matrix
  score 4.80
  seq LVILSLKSQTLDA/ET
  UNSURE 36: Xaa = Lys,Arg
MMAAVPPGLEPWNRVRIPKAGNRSAVTVQNPGAALDLCIAAVIKECHLVILSLKSQTLDAETDVLCAVLYSNHNRMGRHKPHLALKQVEQCLKRLXNMNLEGG

SEQ ID NO: 2179 - protein, 125 aa, Homo Sapiens
  Brain
  SIGNAL -33..-1: Von Heijne matrix
  score 4.80
  seq SLVHLLCQNQVLG/NP
  UNSURE 60: Xaa = Ala,Phe,Ile,Leu,Pro,Ser,Thr,Val
  UNSURE 66: Xaa = Asp,His
  UNSURE 72: Xaa = Lys,Asn
MASLDRVKVLVLGDSGVGKSSLVHLLCQNQVLGNPSWTVGCSVDVRVHDYKEGTPEEKTYYIELWDVGGSVGSASSVKSTRAVFYNSVNGIIXVHDLTXGKSSQXLRRWSLEALNRDLVPTGVLV

SEQ ID NO: 2180 - protein, 75 aa, Homo Sapiens
  Brain
  SIGNAL -31..-1: Von Heijne matrix
  score 4.80
  seq WAFSCGTWLPSRA/EW
  UNSURE 5: Xaa = Ala,Thr
MVFPAKRFCLVPSMEGVRWAFSCGTWLPSRAEWLLXVRSIQPEEKERIGQFVFARDAKAAMAGRLMIRKLVAENR

SEQ ID NO: 2181 - protein, 67 aa, Homo Sapiens
  Surrenals
  SIGNAL -26..-1: Von Heijne matrix; score 4.70; seq LIMQLGSVLLTRC/PF
MASKIGSRRWMLQLIMQLGSVLLTRCPFWGCFSQLMLYAERAEARRKPDIPVPYLYFDMGAAVLCAR

SEQ ID NO: 2182 - protein, 58 aa, Homo Sapiens
  Brain
  SIGNAL -31..-1: Von Heijne matrix; score 4.70; seq LAVDSWWLDPGHA/AV
MLSKGLKRKREEEEEKEPLAVDSWWLDPGHAAVAQAPPAVASSSLFDLSVLKLHHSRG

SEQ ID NO: 2183 - protein, 33 aa, Homo Sapiens
  kidney
  SIGNAL -16..-1: Von Heijne matrix; score 4.70; seq SLAAALTLHGHWG/LG
MDYSLAAALTLHGHWGLGQVVTDYVHGDALQKA

SEQ ID NO: 2184 - protein, 88 aa, Homo Sapiens
  kidney
  SIGNAL -72..-1: Von Heijne matrix
  score 4.70
  seq LSLXASYIFGISG/FE
  UNSURE -10: Xaa = Cys,Ser
  UNSURE -30: Xaa = Leu,Met
MSYITSQEMKCILHWFANWSGPQRERFLEDLVAKAVPEKLQPXLDSLEQLSVSGADDHLLSLXASYIFGISGFEAGAEQERNEFVRQS

SEQ ID NO: 2185 - protein, 78 aa, Homo Sapiens
  Brain
  SIGNAL -76..-1: Von Heijne matrix
  score 4.70
  seq LIVYLWVVSFIAS/SS
  UNSURE -14: Xaa = His,Asn
MPLLCQIEMEYLLLKWQMTMLQSMLCDLVSYPLLPLQQTKEANLDFPKIKVSSVTITPTRWFXLIVYLWVVSFIASSS

SEQ ID NO: 2186 - protein, 67 aa, Homo Sapiens
  Surrenals
  SIGNAL -22..-1: Von Heijne matrix
  score 4.70
  seq SVMGVCLLIPGLA/TA
  UNSURE 6: Xaa = Lys,Arg
MWFEILPGLSVMGVCLLIPGLATAYIHXFTNRGKEKRVAHFGYHWSLMERDRRISGVDRYYVSKGPG

SEQ ID NO: 2187 - protein, 50 aa, Homo Sapiens
  Prostate
  SIGNAL -46..-1: Von Heijne matrix
  score 4.60
  seq LLVSLVLRXPAKS/TR
  UNSURE -5: Xaa = Arg,Thr
MEFKLEAHRIVSISLGKIYNSRVQRGGIKLHKNLLVSLVLRXPAKSTRAG

SEQ ID NO: 2188 - protein, 109 aa, Homo Sapiens
  Brain
  SIGNAL -97..-1: Von Heijne matrix
  score 4.60
  seq IASGLGLXLDCWT/SS
  UNSURE -6: Xaa = Ala,Ser,Thr
  UNSURE -28: Xaa = Pro,Arg
MAVLSKEYGFVLLTGAASFIMVAHLAINVSKARKKYKVEYPIMYSTDPENGHIFNCIQRAHQNTLEVYPXFLFFLAVGGVYHPRIASGLGLXLDCWTSSLCLWLLHGPG

SEQ ID NO: 2189 - protein, 45 aa, Homo Sapiens
  Brain
  SIGNAL -42..-1: Von Heijne matrix; score 4.60; seq RIPSLPGSPVCWA/WP
MDGHWSAAFSALTVTAMSSWARRRSSSSRRIPSLPGSPVCWAWPW

SEQ ID NO: 2190 - protein, 51 aa, Homo Sapiens
  Liver
  SIGNAL -16..-1: Von Heijne matrix; score 4.50; seq RLLLRRFLASVIS/RK
MAQRLLLRRFLASVISRKPSQGQWPPLTSRALQTPQCSPGGLTVTPNPART

SEQ ID NO: 2191 - protein, 30 aa, Homo Sapiens
  Lymph ganglia
  SIGNAL -25..-1: Von Heijne matrix; score 4.50; seq FLLLLEVSHLLLI/IN
MASLKPAFVNYFFLLLLEVSHLLLIINAEG

SEQ ID NO: 2192 - protein, 80 aa, Homo Sapiens
  Substantia nigra
  SIGNAL -77..-1: Von Heijne matrix; score 4.50; seq LFWVIVLTSWITI/FQ
MNLERVSNEEKLNLCRKYYLGGFAFLPFLWLVNIFWFFREAFLVPAYTEQSQIKGYVWRSAVGFLFWVIVLTSWITIFQI

SEQ ID NO: 2193 - protein, 39 aa, Homo Sapiens
  Lung (cells)
  SIGNAL -21..-1: Von Heijne matrix; score 4.40; seq AVASSFFCASLFS/AV
MAQLGAVVAVASSFFCASLFSAVHKIEEGHIGVYYRGGV

SEQ ID NO: 2194 - protein, 64 aa, Homo Sapiens
  kidney
  SIGNAL -25..-1: Von Heijne matrix; score 4.40; seq LVFMVPLVGLIHL/GW
MSLRNLWRDYKVLVFMVPLVGLIHLGWYRIKSSPVFQIPKNDDIPEQDSLGLSNLQKSQIQGIL

SEQ ID NO: 2195 - protein, 25 aa, Homo Sapiens [sequence omitted]

SEQ ID NO: 2196 - protein, 149 aa, Homo Sapiens
  kidney
  SIGNAL -118..-1: Von Heijne matrix
  score 4.40
  seq ILAHRLGLIPIHA/DP
  UNSURE -76: Xaa = Ala,Asp,Asn,Thr
  UNSURE -72: Xaa = Glu,Gly
  UNSURE -70: Xaa = Ile,Asn
MAASQAVEEMRTAWFWGSLGFAMSILLTFPVTIPVMMMPGTRXGFEXRXFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTR

SEQ ID NO: 2197 - protein, 124 aa, Homo Sapiens
  Muscle
  SIGNAL -77..-1: Von Heijne matrix
  score 4.40
  seq FEARIALLPLLQA/ET
  UNSURE 32: Xaa =  * ,Ala,Cys,Asp,Glu,Gly,Ser,Trp,Tyr
  UNSURE 33: Xaa = Ala,Asp,Val
  UNSURE 31: Xaa = Glu,Lys
  UNSURE 25: Xaa = Leu,Pro
  UNSURE 5: Xaa = Lys,Arg
  UNSURE 28: Xaa = Lys,Asn
  UNSURE 22: Xaa = Lys,Gln
MAASKVKQDMPPPGGYGPIDYKRNLPRRGLSGYSMLAIGIGTLIYGHWSIMKWNRERRRLQIEDFEARIALLPLLQAETDRXTLQMLRENLEEEAIIMXDVXDWXVGXXXVPHNPLGAPLDRGA

SEQ ID NO: 2198 - protein, 49 aa, Homo Sapiens
  Lymph ganglia
  SIGNAL -42..-1: Von Heijne matrix; score 4.40; seq VLFFTGWWIIIDA/AV
MSGFLEGLRCSECIDWGEKRNTIASIAAGVLFFTGWWIIIDAAVIYPTR

SEQ ID NO: 2199 - protein, 58 aa, Homo Sapiens
  Brain
  SIGNAL -44..-1: Von Heijne matrix; score 4.40; seq LVFLTFLSIPSFV/GL
MMTQEPGIYTWPEKTRIICSACSSVPLPWTVLVFLTFLSIPSFVGLRNIRAETFLQNV

SEQ ID NO: 2200 - protein, 140 aa, Homo Sapiens
  Substantia nigra
  SIGNAL -14..-1: Von Heijne matrix
  score 4.40
  seq FLTALLWRGRIPG/RQ
  UNSURE 50: Xaa = Ala,Gly,Pro,Arg
  UNSURE 83: Xaa = Gly,Arg,Ser
  UNSURE 82: Xaa = Lys,Asn,Arg,Ser,Thr
MFLTALLWRGRIPGRQWIGKHRRPRFVSLRAKQNMIRRLEIEAENHYWLSMPYMTREQERGHAXLRRREAFEAIKAAATSKFPPHRFIADQLDHLXXHQEMVLILSRHPWILWITELTIFTWSGLKNCSLCENELWTSLY

SEQ ID NO: 2201 - protein, 93 aa, Homo Sapiens
  kidney
  SIGNAL -90..-1: Von Heijne matrix
  score 4.30
  seq TCLTACWTALCCC/CL
  UNSURE -61: Xaa = His,Leu,Pro
MNQENPPPYPGPGPTAPYPPYPPQPMGPGXMGGPYPPPQGYPYQGYPQYGWQGGPQEPPKTTVYVVEDQRRDELGPSTCLTACWTALCCCCLW

SEQ ID NO: 2202 - protein, 119 aa, Homo Sapiens
  kidney
  SIGNAL -54..-1: Von Heijne matrix
  score 4.30
  seq LIVWLLVKSFSES/GI
  UNSURE 53,58: Xaa = Glu,Lys
MASLEVSRSPRRSRRELEVRSPRQNKHSVLLPTYNEREELPLIVWLLVKSFSESGINYEIIIIDDGSPDGTRDVAEQLEKIYGSDRILLRPREKKLGLGTAYIHGMXTCHRXLHHYYGC

SEQ ID NO: 2203 - protein, 35 aa, Homo Sapiens
  Hypertrophic prostate
  SIGNAL -14..-1: Von Heijne matrix
  score 4.20
  seq CPTCLCAPSXXWG/EP
  UNSURE -3: Xaa = Ala,Pro
  UNSURE -4: Xaa = Lys,Asn,Arg,Ser,Thr
MCPTCLCAPSXXWGEPVGSPGLSSPVLSPSKKARS

SEQ ID NO: 2204 - protein, 53 aa, Homo Sapiens
  Brain
  SIGNAL -19..-1: Von Heijne matrix; score 4.20; seq AVAASAASGQAEG/KK
MAAATGAVAASAASGQAEGKKITDLRVIDLKSELKRRNLDITGVKTVLISRLR

SEQ ID NO: 2205 - protein, 137 aa, Homo Sapiens
  kidney
  SIGNAL -17..-1: Von Heijne matrix
  score 4.20
  seq SLLXRVSVTAVAA/LS
  UNSURE 113: Xaa = Ala,Glu
  UNSURE 9: Xaa = Cys,Gly,Arg,Ser
  UNSURE -10: Xaa = Leu,Arg
  UNSURE 67: Xaa = Phe,Ile
MAAMSLLXRVSVTAVAALSGRPLGTXLGFGGFLTRGFPKAAAPVRHSGDHGKRLFVIRPSRFYDRRFLKLLRFYIALTGIPVAXFITLVNVFIGQAELAEIPEGYVPEHWEYYKHPISRWIARNFYDSPXKIYERTM

SEQ ID NO: 2206 - protein, 131 aa, Homo Sapiens
  Lymph ganglia
  SIGNAL -25..-1: Von Heijne matrix
  score 4.20
  seq LDLLRGLPRVSLA/NL
  UNSURE 53: Xaa = Ile,Val
MAGPLQGGGARALDLLRGLPRVSLANLKPNPGSKKPERRPRGRRRGRKCGRGHKGERQRGTRPRLGFEGGQTPFYIRXPKYGFNEGHSFRRQYKPLSLNRLQYLIDLGRVDPSQPIDLTQLVNGRGVTIAP

SEQ ID NO: 2207 - protein, 136 aa, Homo Sapiens
  kidney
  SIGNAL -41..-1: Von Heijne matrix; score 4.10; seq GILILWIIRLLFS/KT
MATATEQWVLVEMVQALYEAPAYHLILEGILILWIIRLLFSKTYKLQERSDLTVKEKEELIEEWQPEPLVPPVPKDHPALNYNIVSGPPSHKTVVNGKECINFASFNFLGLLDNPRVKAAALASLKKYGVGTCGPC

SEQ ID NO: 2208 - protein, 82 aa, Homo Sapiens
  Substantia nigra
  SIGNAL -79..-1: Von Heijne matrix
  score 4.10
  seq QGVLFICFTCARS/FP
  UNSURE -31: Xaa = Glu,Gln
  UNSURE -69: Xaa = Lys,Met,Arg
  UNSURE -32: Xaa = Phe,Leu
MEDPNPEENMXQQDSPKERSPQSPGGNICHLGAPKCTRCLITFADSKXXERHMKREHPADFVAQKLQGVLFICFTCARSFPS

SEQ ID NO: 2209 - protein, 142 aa, Homo Sapiens
  Normal prostate
  SIGNAL -32..-1: Von Heijne matrix
  score 4.10
  seq RLLSSLLLTMSNN/NP
  UNSURE 96: Xaa = Ala,Cys,Gly,Ser
MNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKYKMAECYTMLKQDKDAIAILDGXPFKTKNSQNKHDAG

SEQ ID NO: 2210 - protein, 72 aa, Homo Sapiens
  Brain
  SIGNAL -58..-1: Von Heijne matrix; score 4.10; seq LVHHCPTWQWATG/EE
MQNVINTVKGKALEVAEYLTPVLKESKFKETGVITPEEFVAAGDHLVHHCPTWQWATGEELKVKAYLPTGKW

SEQ ID NO: 2211 - protein, 91 aa, Homo Sapiens [sequence omitted]

SEQ ID NO: 2212 - protein, 72 aa, Homo Sapiens
  Brain
  SIGNAL -49..-1: Von Heijne matrix
  score 4.00
  seq PSLAAGLLFGSXA/GL
  UNSURE -2: Xaa = Glu,Ile,Lys,Leu,Gln,Val
MEKPLFPLVPLHWFGFGYTALVVSGGIVGYVKTGSVPSLAAGLLFGSXAGLGAYQLYQDPRNVWGFLAATSV

SEQ ID NO: 2213 - protein, 65 aa, Homo Sapiens
  Normal prostate
  SIGNAL -18..-1: Von Heijne matrix
  score 4.00
  seq VAVGLTIAAAGFA/GR
  UNSURE 41: Xaa = Ala,Thr
  UNSURE 35: Xaa = Gly,Arg,Trp
  UNSURE 13: Xaa = Leu,Pro,Arg
  UNSURE 39: Xaa = Lys,Arg
MASTVVAVGLTIAAAGFAGRYVLQAMKHMEXQVKQVFQSLPKSAFSGGYYRGXFEPXMXKREAAG

SEQ ID NO: 2214 - protein, 110 aa, Homo Sapiens
  Brain
  SIGNAL -83..-1: Von Heijne matrix; score 4.00; seq AFSFSRLLSQCRP/DC
MVIRVYIASSSGSTAIKKKQQDVLGFLEANKIGFEEKDIAANEENRKWMRENVPENSRPAVQGPHAFRYKAFSFSRLLSQCRPDCLNMLRRFSQYCLYLVMEKALLFFFF

SEQ ID NO: 2215 - protein, 53 aa, Homo Sapiens
  Brain
  SIGNAL -42..-1: Von Heijne matrix; score 4.00; seq ITSSLFLGRGSVA/SN
MSSRGHSTLPRTLMAPRMISEGDIGGIAQITSSLFLGRGSVASNRHLLQARGI

SEQ ID NO: 2216 - protein, 55 aa, Homo Sapiens
  Dystrophic muscle
  SIGNAL -18..-1: Von Heijne matrix; score 3.90; seq PALCLFDVDGTLT/AP
MAAPGPALCLFDVDGTLTAPRQKITKEMDDFLQKLRQKIKIGVVGGSDFEKVQER

SEQ ID NO: 2217 - protein, 33 aa, Homo Sapiens
  Normal prostate
  SIGNAL -19..-1: Von Heijne matrix; score 3.90; seq ILFHGVFYAGGFA/IV
MPLGARILFHGVFYAGGFAIVYYLIQKFHSRTL

SEQ ID NO: 2218 - protein, 57 aa, Homo Sapiens
  Cancerous prostate
  SIGNAL -13..-1: Von Heijne matrix
  score 3.90
  seq MLLSIGMLMLSAT/QV
  UNSURE 21: Xaa = Ala,Val
MLLSIGMLMLSATQVYTILTVQLFAFLNLLPVEXDILAYNFENASQTFDDLPARFGY

SEQ ID NO: 2219 - protein, 96 aa, Homo Sapiens
  Uterus
  SIGNAL -25..-1: Von Heijne matrix
  score 3.90
  seq WIAAVTIAAGTAA/IG
  UNSURE 41: Xaa = Ala,Glu,Gly,Ile,Lys,Arg,Thr,Val
  UNSURE 65: Xaa = Asp,His,Asn
  UNSURE 64: Xaa = Lys,Asn,Arg,Ser
  UNSURE 40: Xaa = Phe,Leu
MSLTSSSSVRVEWIAAVTIAAGTAAIGYLAYKRFYVKDHRNKAMINLHIQKDNPKIVHAFDMEDXXDKAVYCRCWRSKKFPFCDGAHTXXNEETGL

SEQ ID NO: 2220 - protein, 108 aa, Homo Sapiens
  Cancerous prostate
  SIGNAL -61..-1: Von Heijne matrix
  score 3.90
  seq YTAVSVLAGPRWA/DP
  UNSURE 23: Xaa =  * ,Glu,Lys,Gln
  UNSURE 6,32: Xaa = Asp,Glu
  UNSURE 8: Xaa = Asp,His,Asn
MSGSNGSKENSHNKARTSPYPGSKVERSQVPNEKVGWLVEWQDYKPVEYTAVSVLAGPRWADPQISXSXFSPKFNEKDGHVERXSKNGLYEIXNGRPRNPADGLDWWA

SEQ ID NO: 2221 - protein, 42 aa, Homo Sapiens
  Cancerous prostate
  SIGNAL -30..-1: Von Heijne matrix
  score 3.90
  seq LWMRWTVTSTTRA/WI
  UNSURE 3: Xaa = Ala,Asp,Glu,Gly,Ile,Lys,Met,Asn,Arg,Ser,Thr,Val
MAISLRSSGISVKCLSKLWMRWTVTSTTRAWIXAEPPQLDIS

SEQ ID NO: 2222 - protein, 65 aa, Homo Sapiens
  Uterus
  SIGNAL -27..-1: Von Heijne matrix
  score 3.80
  seq FVLGSARLGGSGS/MR
  UNSURE 8: Xaa =  * ,Leu,Pro,Gln,Ser
MSEVRLPPLRALDDFVLGSARLGGSGSMRPAAMVXPRHQQPPLLPNQLPSLLRHRPRSRRVRTAT

SEQ ID NO: 2223 - protein, 19 aa, Homo Sapiens
  Muscle
  SIGNAL -15..-1: Von Heijne matrix; score 3.80; seq LVSATAWLEECWW/SE
MKLVSATAWLEECWWSELS

SEQ ID NO: 2224 - protein, 38 aa, Homo Sapiens
  Brain
  SIGNAL -34..-1: Von Heijne matrix; score 3.80; seq LYVPLLAVCCLHS/VV
MKAISVSLLRLTKLLWFFSIVLYVPLLAVCCLHSVVFF

SEQ ID NO: 2225 - protein, 143 aa, Homo Sapiens
  Thyroid
  SIGNAL -118..-1: Von Heijne matrix
  score 3.80
  seq LMIALTVVGCIFM/VI
  UNSURE -95: Xaa =  * ,Cys,Trp
  UNSURE -37: Xaa =  * ,Glu,Lys,Gln
  UNSURE -26: Xaa = Asp,Glu
  UNSURE 18: Xaa = His,Asn
  UNSURE -38: Xaa = Ile,Lys,Met,Asn,Arg,Ser,Thr
  UNSURE -25: Xaa = Leu,Val
MGSLSGLRLAAGSCFRLCERDVSXSLRLTRSSDLKRINGFCTKPQESPGAPSRTYNRVPLHKPTDWQKKILIWSGRFKKEXXIPETVSLEMLXXAKNKMRVKISYLMIALTVVGCIFMVIEGKKAAQRHETLTSLXLEKKARL

SEQ ID NO: 2226 - protein, 118 aa, Homo Sapiens
  Brain
  SIGNAL -100..-1: Von Heijne matrix
  score 3.70
  seq LASSFLFTMGGLG/FI
  UNSURE 8: Xaa = Ala,Asp,Gly,Ile,Asn,Ser,Thr,Val
METLYRVPFLVLECPNLKLKKPPWLHMPSAMTVYALVVVSYFLITGGIIYDVIVEPPSVGSMTDEHGHQRPVAFLAYRVNGQYIMEGLASSFLFTMGGLGFIILDGSXAPNIPKLNRF

SEQ ID NO: 2227 - protein, 57 aa, Homo Sapiens
  Cancerous prostate
  SIGNAL -13..-1: Von Heijne matrix
  score 3.70
  seq MLVLRSGLTKALA/SR
  UNSURE 6: Xaa = His,Pro,Arg
  UNSURE 8: Xaa = Ile,Arg
  UNSURE 9: Xaa = Ile,Asn
MLVLRSGLTKALASRTLAXQXXFAHRAEVRKALANCKEWQEQSIIPNLARIDKQETR

SEQ ID NO: 2228 - protein, 72 aa, Homo Sapiens
  Thyroid
  SIGNAL -36..-1: Von Heijne matrix
  score 3.70
  seq NIESLAWTGGTLG/HP
  UNSURE 18: Xaa = Arg,Thr
  UNSURE -21: Xaa = Asp,Glu
MAAPLSVEVEFGGGAXSCLTVLRNIESLAWTGGTLGHPEPAHLDQEEFAKRAAXVVHPGRQRAARNSGADYR

SEQ ID NO: 2229 - protein, 68 aa, Homo Sapiens
  Umbilical cord
  SIGNAL -65..-1: Von Heijne matrix; score 3.70; seq FVGGLPVIFWSWA/GL
MTHLIEYDRHRKSRLSPLQHLYLLPADHSRNAAERFPGAWFQPPTVDSEASAFVGGLPVIFWSWAGLV

SEQ ID NO: 2230 - protein, 104 aa, Homo Sapiens
  Uterus
  SIGNAL -22..-1: Von Heijne matrix; score 3.70; seq WARKLLSVPWLLC/GP
MAAAALGQIWARKLLSVPWLLCGPRRYASSSFKAADLQLEMTQKPHKKPGPGEPLVFGKTFTDHMLMVEWNDKGWGQPRIQPFQNLTLHPASSSLHYSLQLFEG

SEQ ID NO: 2231 - protein, 99 aa, Homo Sapiens
  Hypertrophic prostate
  SIGNAL -38..-1: Von Heijne matrix
  score 3.70
  seq CPLLLLVFTTNNG/RH
  UNSURE 44: Xaa =  * ,Lys
  UNSURE 53: Xaa = Ile,Leu,Val
MAVESRVTQEEIKKEPEKPIDREKTCPLLLLVFTTNNGRHHRMDEFSRGNVPSSELQIYTWMDATLKELTSLVKEVYPEARXKGTHFNFAXVFTDVKRP

SEQ ID NO: 2232 - protein, 54 aa, Homo Sapiens
  kidney
  SIGNAL -22..-1: Von Heijne matrix; score 3.70; seq AVLDCAFYDPTHA/WS
MRLKYQHTGAVLDCAFYDPTHAWSGGLDHQLKMHDLNTDQENLVGTMMPLSDVL

SEQ ID NO: 2233 - protein, 88 aa, Homo Sapiens
  Uterus
  SIGNAL -86..-1: Von Heijne matrix
  score 3.70
  seq WAVVLADTAVTSG/RG
  UNSURE -52: Xaa = Ala,Glu
MALLFARSLRLCRWGAKRLGVASTEAQRGVSFKLXEKTAHSSLALFRDDTGVKYGLVGLEPTKVALNVERFREWAVVLADTAVTSGRG

SEQ ID NO: 2234 - protein, 107 aa, Homo Sapiens
  Umbilical cord
  SIGNAL -68..-1: Von Heijne matrix
  score 3.60
  seq ILLGNYCVAVADA/KK
  UNSURE -60: Xaa = Ala,Glu,Gly,Leu,Pro,Gln,Arg,Val
MAAAAAGTXTSQRFFQSFSDALIDEDPQAALEELTKALEQKPDDAQYYCQRAYCHILLGNYCVAVADAKKSLELNPNNSTAMLRKGICEYHEKNYAAALETFYRRTG

SEQ ID NO: 2235 - protein, 81 aa, Homo Sapiens
  kidney
  SIGNAL -60..-1: Von Heijne matrix; score 3.50; seq WFYIGSSLNGTRG/KR
MAQLKYMENVGYAQEDRERMHRNIVSLAQNLLNFMIGSILDLWQCFLWFYIGSSLNGTRGKRVPAHFSNTSLHYLNAAWPR

SEQ ID NO: 2236 - protein, 40 aa, Homo Sapiens
  Brain
  SIGNAL -31..-1: Von Heijne matrix; score 3.50; seq WSPLSTRSGGTHA/CS
MSPAFRAMDVEPRAKGSFWSPLSTRSGGTHACSASMRQPW

SEQ ID NO: 2237 - protein, 110 aa, Homo Sapiens
  Substantia nigra
  SIGNAL -54..-1: Von Heijne matrix
  score 3.50
  seq SILAQVLDQSARA/RL
  UNSURE 52: Xaa = Ile,Lys,Met,Asn,Thr
MADEELEALRRQRLAELQAKHGDPGDAAQQEAKHREAEMRNSILAQVLDQSARARLSNLALVKPEKTKAVENYLIQMARYGQLSEKVSEQGLIEILKKVSQQTEKXTTVR

SEQ ID NO: 2238 - protein, 86 aa, Homo Sapiens
  Cancerous prostate
  SIGNAL -63..-1: Von Heijne matrix
  score 3.50
  seq GLVCAGLADMARP/AE
  UNSURE 10: Xaa = Ala,Asp,Glu,Gly
MSAAGARGLRATYHRLLDKVELMLPEKLRPLYNHPAGPRTVFFWAPIMKWGLVCAGLADMARPAEKLSTAQSXVLMATGFIWSRYS

SEQ ID NO: 2239 - protein, 127 aa, Homo Sapiens
  Muscle
  SIGNAL -86..-1: Von Heijne matrix
  score 3.50
  seq TGXLNMTLQRASA/AP
  UNSURE -11: Xaa = Ala,Phe,Ile,Leu,Pro,Ser,Thr,Val
MSNYSVSLVGPAPWGFRLQGGKDFNMPLTISSLKDGGKAAQANVRIGDVVLSIDGINAQGMTHLEAQNKIKGCTGXLNMTLQRASAAPKPEPVPVQKPTVTSVCSETSQELAEGQRRGSQGDSKQQN

SEQ ID NO: 2240 - protein, 37 aa, Homo Sapiens
  Uterus
  SIGNAL -18..-1: Von Heijne matrix; score 3.50; seq LLGLELSEAEAIG/AD
MANPKLLGLELSEAEAIGADSARFEELLLQASKELQQ

SEQ ID NO: 2241 - protein, 66 aa, Homo Sapiens
  brain
  SIGNAL -40..-1: Von Heijne matrix
  score 3.50
  seq ALLCTLLLHFQNI/RR
  UNSURE 17: Xaa = Phe,Ser,Tyr
MIIPLLEILIIIVLNEVLLFDVNSVYKALLCTLLLHFQNIRRFLSSQSPMKAVSLLXFHQPDFDYI

SEQ ID NO: 2242 - protein, 102 aa, Homo Sapiens
  Lymph ganglia
  SIGNAL -52..-1: Von Heijne matrix
  score 7.40
  seq LVFIIGLVGNLLA/LV
  UNSURE 40: Xaa = Pro,Gln
MDIQMANNFTPPSATPQGNDCDLYAHHSTARIVMPLHYSLVFIIGLVGNLLALVVIVQNRKKINSTTLYSTNLVISDILFTTALPTRIATMXWALTGESEMW

SEQ ID NO: 2243 - protein, 35 aa, Homo Sapiens
  Pancreas
  SIGNAL -29..-1: Von Heijne matrix; score 7.00; seq SMIGIGSLPSCWA/CW
MLTIVKSPQKSYLFPSSMIGIGSLPSCWACWIQQR

SEQ ID NO: 2244 - protein, 32 aa, Homo Sapiens
  Umbilical cord
  SIGNAL -14..-1: Von Heijne matrix; score 11.80; seq VLVALILLHSALA/QS
MVLVALILLHSALAQSRRDFAPPGQQKREAPG

SEQ ID NO: 2245 - protein, 68 aa, Homo Sapiens
  Lymph ganglia
  SIGNAL -21..-1: Von Heijne matrix; score 10.00; seq LLLCLQTWPEAAG/KD
MAQHHLWILLLCLQTWPEAAGKDSEIFTVNGILGESVTFPVNIQEPRQVKIIAWTSKTSVAYVTPGER

SEQ ID NO: 2246 - protein, 103 aa, Homo Sapiens
  Lymph ganglia
  SIGNAL -19..-1: Von Heijne matrix
  score 10.00
  seq FLLLVTAPRCILS/QV
  UNSURE 65: Xaa = Ile,Leu
MKDLWIFLLLVTAPRCILSQVQLQESGPRLVRPSETVSLSCTVSGDSVSSGDHYWTWLRQPPGGGLEWIGYIYTTGKIDYNPSXRRRVTISVDTSKNLFSLTR

SEQ ID NO: 2247 - protein, 79 aa, Homo Sapiens
  Placenta
  SIGNAL -21..-1: Von Heijne matrix; score 10.00; seq LLLCLQTWPEAAG/KD
MAQHHLWILLLCLQTWPEAAGKDSEIFTVNGILGESVTFPVNIQEPRQVKIIAWTSKTSVAYVTPGDSETAPVVTVTHM

SEQ ID NO: 2248 - protein, 58 aa, Homo Sapiens
  Lymph ganglia
  SIGNAL -19..-1: Von Heijne matrix; score 9.90; seq FLFVVAAATGVQS/QV
MDWTWRFLFVVAAATGVQSQVQLVQSGAEVVKPGSSVKVSCKTSGDGFSKYPINWVQG

SEQ ID NO: 2249 - protein, 62 aa, Homo Sapiens [sequence omitted]

SEQ ID NO: 2250 - protein, 22 aa, Homo Sapiens
  Lymph ganglia
  SIGNAL -17..-1: Von Heijne matrix; score 9.20; seq LVLLILPLLSSLS/KV
MIGFLVLLILPLLSSLSKVSSK

SEQ ID NO: 2251 - protein, 39 aa, Homo Sapiens
  Lymph ganglia
  SIGNAL -31..-1: Von Heijne matrix
  score 8.90
  seq LLMSLLVSTVTWQ/IS
  UNSURE -18: Xaa = Ala,Ser
MQCLLSVLMAQFIXHFLSLLMSLLVSTVTWQISRTPWHG

SEQ ID NO: 2252 - protein, 87 aa, Homo Sapiens
  Lymph ganglia
  SIGNAL -19..-1: Von Heijne matrix
  score 8.90
  seq WIFFLATLKGVQC/QV
  UNSURE 56: Xaa = Phe,His,Ile,Leu,Asn,Tyr
MELGLSWIFFLATLKGVQCQVRLLESAGGLQEPGGALRLSCAVSGFIFNDFAMHWVRQTPGKGLEWVAGINWDGXILGYADSVKGRR

SEQ ID NO: 2253 - protein, 59 aa, Homo Sapiens [sequence omitted]

SEQ ID NO: 2254 - protein, 57 aa, Homo Sapiens
  Placenta
  SIGNAL -21..-1: Von Heijne matrix; score 8.50; seq LPLLLSWVAGGFG/NA
MPLPWSLALPLLLSWVAGGFGNAASARHHGLLASARQPGVCHYGTKLACCYGWRRNS

SEQ ID NO: 2255 - protein, 114 aa, Homo Sapiens
  Lymph ganglia
  SIGNAL -80..-1: Von Heijne matrix
  score 8.40
  seq FVVFSLFLICAMA/GD
  UNSURE 27: Xaa = Ala,Pro
  UNSURE 32: Xaa = Arg,Ser
  UNSURE -48: Xaa = Arg,Thr
  UNSURE 26: Xaa = Gly,Val
  UNSURE 33: Xaa = Ile,Leu
  UNSURE 21: Xaa = Phe,Leu
  UNSURE 20: Xaa = Phe,Ser
MVSNFFHVIQVFEKSATLISKTEHIGFVIYSWXKSTTHLGSRRKFAISIYLSEVSLQKYDCPFSGTSFVVFSLFLICAMAGDVVYADIKTVRTSPLELAXXLQRSXXFNFSXXR

SEQ ID NO: 2256 - protein, 80 aa, Homo Sapiens
  Lymph ganglia
  SIGNAL -44..-1: Von Heijne matrix
  score 8.20
  seq ICLACVLFPLLRT/SD
  UNSURE -42: Xaa = His,Leu,Pro,Gln,Arg
MRXFWFLMYPFRFHDCKQKYDLYISIAGWLIICLACVLFPLLRTSDDTPGNRTKCFVDLPTRNVNLAQSVVMMTIGELIG

SEQ ID NO: 2257 - protein, 64 aa, Homo Sapiens
  Lymph ganglia
  SIGNAL -17..-1: Von Heijne matrix
  score 7.00
  seq CCLFTCFFIPCIS/CK
  UNSURE 28: Xaa = Phe,Ile,Leu,Val
MVSLCCLFTCFFIPCISCKLEMWGLDEPKVKPFWQECVLGDVVGXILQHRRQPPVPRSILVMGA

SEQ ID NO: 2258 - protein, 30 aa, Homo Sapiens
  Placenta
  SIGNAL -27..-1: Von Heijne matrix; score 6.90; seq ILLLVTYSPIAYS/HS
MDFFFLERSYWGKMILLLVTYSPIAYSHSR

SEQ ID NO: 2259 - protein, 55 aa, Homo Sapiens
  Lymph ganglia
  SIGNAL -26..-1: Von Heijne matrix
  score 6.90
  seq LWVLLLCAHVVTL/LV
  UNSURE 11: Xaa = Ile,Thr
MTMRHNWTPDLSPLWVLLLCAHVVTLLVRATPVSQTXTAATASVRSTKDPCPTQG

SEQ ID NO: 2260 - protein, 59 aa, Homo Sapiens
  Lymph ganglia
  SIGNAL -48..-1: Von Heijne matrix; score 6.80; seq ILRMLLSLQPVLQ/DA
MDNMSGGKVDEALVKSSCLHPWSKRNDVSMQCSQDILRMLLSLQPVLQDAIQKKRTVRQ

SEQ ID NO: 2261 - protein, 59 aa, Homo Sapiens
  Lymph ganglia
  SIGNAL -45..-1: Von Heijne matrix
  score 6.70
  seq AALVLWTLPGAQR/RG
  UNSURE -44: Xaa =  * ,Arg
  UNSURE -19: Xaa = Leu,Arg
MXLQGQEATGKVLIKIHKDTSQVPTAXGDASIAALVLWTLPGAQRRGEFAPKGAPMTNR

SEQ ID NO: 2262 - protein, 29 aa, Homo Sapiens [sequence omitted]

SEQ ID NO: 2263 - protein, 32 aa, Homo Sapiens [sequence omitted]

SEQ ID NO: 2264 - protein, 41 aa, Homo Sapiens [sequence omitted]

SEQ ID NO: 2265 - protein, 27 aa, Homo Sapiens
  Lymph ganglia
  SIGNAL -22..-1: Von Heijne matrix
  score 6.30
  seq MVSFLSXPFLCSA/KP
  UNSURE -20: Xaa = Arg,Thr
  UNSURE -16: Xaa = Cys,Phe
  UNSURE -7: Xaa = His,Ile,Leu,Asn
  UNSURE -17: Xaa = Ile,Asn,Ser
  UNSURE -21: Xaa = Lys,Asn,Arg,Ser
MXXLGXXRFMVSFLSXPFLCSAKPSSG

SEQ ID NO: 2266 - protein, 71 aa, Homo Sapiens
  Lymph ganglia
  SIGNAL -19..-1: Von Heijne matrix; score 6.30; seq ILVSVAAATGAHS/QL
MDWTWYILVSVAAATGAHSQLQLLQSGSDIKKPGASMNVSCKASGGSISTRGISWVRQVPGQGLEWMGWIG

SEQ ID NO: 2267 - protein, 56 aa, Homo Sapiens
  Lymph ganglia
  SIGNAL -45..-1: Von Heijne matrix
  score 6.30
  seq VACVLSSLIAVNS/AH
  UNSURE -14: Xaa =  * ,Ala,Glu,Gly,Lys,Leu,Met,Pro,Gln,Arg,Ser,Thr,Val,Trp
MISKFSSKAYSVRGLELFSLLPINPSPNSAIXVACVLSSLIAVNSAHPESTIDTRW

SEQ ID NO: 2268 - protein, 30 aa, Homo Sapiens [sequence omitted]

SEQ ID NO: 2269 - protein, 105 aa, Homo Sapiens
  Lymph ganglia
  SIGNAL -35..-1: Von Heijne matrix
  score 6.30
  seq ALKLLLSPGXSGS/SS
  UNSURE -4: Xaa = Gly,Arg
MAARQAVGSGAQETCGLDRILEALKLLLSPGXSGSSSLQVTKHDVLLATLKSNLSALEDKFLKDPQWKNLKLLRDEIADKAEWPQNSVDVTWSFTSQTLLLLLCL

SEQ ID NO: 2270 - protein, 55 aa, Homo Sapiens [sequence omitted]

SEQ ID NO: 2271 - protein, 27 aa, Homo Sapiens [sequence omitted]

SEQ ID NO: 2272 - protein, 44 aa, Homo Sapiens
  Lymph ganglia
  SIGNAL -42..-1: Von Heijne matrix; score 6.10; seq AILLLQSQCAYWA/LP
MCFPEHRRQMYIQDRLDSVTRRARQGRICAILLLQSQCAYWALP

SEQ ID NO: 2273 - protein, 33 aa, Homo Sapiens [sequence omitted]

SEQ ID NO: 2274 - protein, 104 aa, Homo Sapiens
  Lymph ganglia
  SIGNAL -32..-1: Von Heijne matrix
  score 6.10
  seq LPLLTSALHGLQQ/QH
  UNSURE -30: Xaa = Ala,Ser
MIXLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLG

SEQ ID NO: 2275 - protein, 17 aa, Homo Sapiens
  Lymph ganglia
  SIGNAL -14..-1: Von Heijne matrix; score 5.90; seq ITMMLALISVCLF/AF
MITMMLALISVCLFAFW

SEQ ID NO: 2276 - protein, 52 aa, Homo Sapiens
  Umbilical cord
  SIGNAL -15..-1: Von Heijne matrix; score 5.90; seq LLTLVQCSDLCPS/CS
MWLLTLVQCSDLCPSCSQALTLVLVSFSEVRDLAETSLSSNLKNSLFIVLKR

SEQ ID NO: 2277 - protein, 51 aa, Homo Sapiens [sequence omitted]

SEQ ID NO: 2278 - protein, 47 aa, Homo Sapiens [sequence omitted]

SEQ ID NO: 2279 - protein, 39 aa, Homo Sapiens
  Umbilical cord
  SIGNAL -32..-1: Von Heijne matrix
  score 5.50
  seq CLLSXPSTRKSQA/CM
  UNSURE -17: Xaa = Ala,Glu,Pro,Gln
  UNSURE -9: Xaa = Ile,Leu
MAGSRLPRQLFLQGVXASSCLLSXPSTRKSQACMAPRAW

SEQ ID NO: 2280 - protein, 35 aa, Homo Sapiens
  Lymph ganglia
  SIGNAL -28..-1: Von Heijne matrix
  score 5.40
  seq FVLHLLAQDLVCC/FY
  UNSURE 6: Xaa =  * ,Cys,Phe,Leu,Ser,Trp,Tyr
  UNSURE 7: Xaa =  * ,Glu,Gln
MYICFCLESFEIKCGFVLHLLAQDLVCCFYLRTXX

SEQ ID NO: 2281 - protein, 35 aa, Homo Sapiens [sequence omitted]

SEQ ID NO: 2282 - protein, 37 aa, Homo Sapiens [sequence omitted]

SEQ ID NO: 2283 - protein, 54 aa, Homo Sapiens
  Umbilical cord
  SIGNAL -23..-1: Von Heijne matrix; score 5.20; seq LLDLHCFCSLAKT/KN
MVVWVLEVRFLLDLHCFCSLAKTKNGLSWGLPQKVALCTPCSAPALFWFGFHIL

SEQ ID NO: 2284 - protein, 43 aa, Homo Sapiens
  Lymph ganglia
  SIGNAL -24..-1: Von Heijne matrix
  score 5.20
  seq PGLCCPALGSAWS/KN
  UNSURE 5: Xaa = Leu,Met,Val
MVCGWWTQGPVPGLCCPALGSAWSKNKSXPVPCCGPYMVANLG

SEQ ID NO: 2285 - protein, 44 aa, Homo Sapiens
  Lymph ganglia
  SIGNAL -26..-1: Von Heijne matrix
  score 5.20
  seq FECALVSASLTTA/GT
  UNSURE 8: Xaa = Cys,Ser
MGRAFPSRHKTARFECALVSASLTTAGTPGKNLXSYNSAEARHI

SEQ ID NO: 2286 - protein, 23 aa, Homo Sapiens
  Placenta
  SIGNAL -18..-1: Von Heijne matrix
  score 5.00
  seq LCXXLLCVLFVSH/FY
  UNSURE -10: Xaa = Gly,Arg
  UNSURE -11: Xaa = Phe,Leu
MGLKALCXXLLCVLFVSHFYTPT

SEQ ID NO: 2287 - protein, 94 aa, Homo Sapiens
  Lymph ganglia
  SIGNAL -76..-1: Von Heijne matrix; score 5.00; seq FPLLALLFEKCEQ/ST
MMATQTLSIDSYQDGQQMQVVTELKTEQDPNCSEPDAEGVSPPPVESQTPMDVDKQAIYRHPLFPLLALLFEKCEQSTQGSEGTTSASFDVDIG

SEQ ID NO: 2288 - protein, 32 aa, Homo Sapiens [sequence omitted]

SEQ ID NO: 2289 - protein, 32 aa, Homo Sapiens [sequence omitted]

SEQ ID NO: 2290 - protein, 35 aa, Homo Sapiens
  Lymph ganglia
  SIGNAL -14..-1: Von Heijne matrix; score 4.80; seq LFLKYLWRSLCRG/GI
MLFLKYLWRSLCRGGIIRMNHPGCSQRIRDSLCDL

SEQ ID NO: 2291 - protein, 95 aa, Homo Sapiens
  Lymphocytes
  SIGNAL -37..-1: Von Heijne matrix; score 4.80; seq AILIRPLVSVSGS/GP
MALLAMHSWRWAAAAAAFEKRRHSAILIRPLVSVSGSGPQWRPHQLGALGTARAYQIPESLKSITWQRLGKGNSGQFLDAAKALQVWPLIEKRTW

SEQ ID NO: 2292 - protein, 49 aa, Homo Sapiens
  Placenta
  SIGNAL -38..-1: Von Heijne matrix
  score 4.80
  seq LASLFGLDQXAAG/HG
  UNSURE -4: Xaa = Ala,Gly
  UNSURE -35: Xaa = Asn,Ser
  UNSURE 4: Xaa = Glu,Gly
  UNSURE 5: Xaa = Phe,Leu
MKAXAMFGAGDEDDTDFLSPSGGARLASLFGLDQXAAGHGNXXFQYTAP

SEQ ID NO: 2293 - protein, 21 aa, Homo Sapiens [sequence omitted]

SEQ ID NO: 2294 - protein, 50 aa, Homo Sapiens [sequence omitted]

SEQ ID NO: 2295 - protein, 34 aa, Homo Sapiens
  Lymph ganglia
  SIGNAL -15..-1: Von Heijne matrix
  score 4.70
  seq WQLLXGFCGSYSA/AQ
  UNSURE -9: Xaa =  * ,Ala,Gly,Leu,Pro,Arg,Ser,Val
MHWQLLXGFCGSYSAAQAEAQTLPGLHSKYNTHG

SEQ ID NO: 2296 - protein, 65 aa, Homo Sapiens
  Umbilical cord
  SIGNAL -37..-1: Von Heijne matrix
  score 4.60
  seq FVFLLFFFSXLXY/FM
  UNSURE 12: Xaa =  * ,Cys
  UNSURE 20,21: Xaa = Arg,Ser
  UNSURE -4,22: Xaa = Asn,Tyr
  UNSURE -2: Xaa = Gly,Leu,Arg,Val
  UNSURE 23: Xaa = Phe,Leu
MTMMVMASFLPRNTMYTNTMNYSIFVFLLFFFSXLXYFMYKTSHFSPSXICYFSPMXXXXDLPNG

SEQ ID NO: 2297 - protein, 100 aa, Homo Sapiens
  Umbilical cord
  SIGNAL -61..-1: Von Heijne matrix; score 4.50; seq LVTRLALCQSPRA/GQ
MPSQTLSQPRISVLHGDLVPAGMAVQEIGAQMVLPCEVVSGSGLTREHLVTRLALCQSPRAGQHGADSEEEAFGILPVRHSHRLSACHTPGELRFSEWTC

SEQ ID NO: 2298 - protein, 44 aa, Homo Sapiens
  Lymph ganglia
  SIGNAL -38..-1: Von Heijne matrix; score 4.50; seq LLMITVTVGPGAS/GV
MSLRVHTLPTLLGAVVRPGCRELLCLLMITVTVGPGASGVCPSG

SEQ ID NO: 2299 - protein, 20 aa, Homo Sapiens
  Lymph ganglia
  SIGNAL -18..-1: Von Heijne matrix; score 4.50; seq SLLLLGRWLTLTS/SG
MIYLTSLLLLGRWLTLTSSG

SEQ ID NO: 2300 - protein, 24 aa, Homo Sapiens
  Umbilical cord
  SIGNAL -22..-1: Von Heijne matrix; score 4.40; seq GFLLCPLVCGLRR/WT
MNWNVRGTRGFLLCPLVCGLRRWT

SEQ ID NO: 2301 - protein, 44 aa, Homo Sapiens [sequence omitted]

SEQ ID NO: 2302 - protein, 100 aa, Homo Sapiens
  Umbilical cord
  SIGNAL -84..-1: Von Heijne matrix
  score 4.40
  seq GLVQLHATXLALG/KV
  UNSURE -5: Xaa = Pro,Ser
MIIPLPSLVGCWEGGNGKGLMVSDTTCWTLASSNVPSPSPAPTLGRGAPSHTPQKKPTIPGARHRPIILPKGLVQLHATXLALGKVCLPHVPHHASLRPA

SEQ ID NO: 2303 - protein, 57 aa, Homo Sapiens
  Lymphocytes
  SIGNAL -42..-1: Von Heijne matrix
  score 4.30
  seq IQTVHIALPGSLG/HP
  UNSURE -23: Xaa =  * ,Cys,Tyr
MSMRLSGERIYLLLEVWLPXLNFESVLHFIQTVHIALPGSLGHPMGPCACRPSLAHP

SEQ ID NO: 2304 - protein, 18 aa, Homo Sapiens
  Lymph ganglia
  SIGNAL -16..-1: Von Heijne matrix; score 4.30; seq LLLFCFMPVVINP/DR
MGTLLLFCFMPVVINPDR

SEQ ID NO: 2305 - protein, 56 aa, Homo Sapiens
  Lymph ganglia
  SIGNAL -22..-1: Von Heijne matrix; score 4.10; seq GIYLQLFFLSIVS/QP
MVVLNPMTLGIYLQLFFLSIVSQPTFINSVLPISAALPSLDQKKRGGHKACCLLTP

SEQ ID NO: 2306 - protein, 49 aa, Homo Sapiens
  Lymph ganglia
  SIGNAL -36..-1: Von Heijne matrix; score 4.10; seq HWLFLASLSGIKT/YQ
MAPHTASFGVCPLLSVTRVVATEHWLFLASLSGIKTYQSYISVFCKVTG

SEQ ID NO: 2307 - protein, 23 aa, Homo Sapiens [sequence omitted]

SEQ ID NO: 2308 - protein, 25 aa, Homo Sapiens [sequence omitted]

SEQ ID NO: 2309 - protein, 33 aa, Homo Sapiens [sequence omitted]

SEQ ID NO: 2310 - protein, 57 aa, Homo Sapiens
  Lymph ganglia
  SIGNAL -54..-1: Von Heijne matrix
  score 4.10
  seq LLLFCFMPVVINP/DX
  UNSURE -46: Xaa = Ala,Gly,Arg,Ser,Thr
  UNSURE -49: Xaa = Asp,Glu,His,Leu,Gln,Val
  UNSURE -33: Xaa = Asp,Gly
  UNSURE -51: Xaa = His,Gln
  UNSURE -45: Xaa = Lys,Arg
  UNSURE 2: Xaa = Lys,Asn,Arg,Ser
  UNSURE -39: Xaa = Ser,Trp
MSCXVXDAXXRWWAHXLIIGWXHLTQKVHPIALSHCVNMGTLLLFCFMPVVINPDXG

SEQ ID NO: 2311 - protein, 30 aa, Homo Sapiens [sequence omitted]

SEQ ID NO: 2312 - protein, 53 aa, Homo Sapiens
  Lymph ganglia
  SIGNAL -14..-1: Von Heijne matrix
  score 4.00
  seq FSLIIFFFPPSSP/XA
  UNSURE 25: Xaa =  * ,Cys
  UNSURE 26: Xaa = His,Asn
  UNSURE 20: Xaa = Ile,Leu
  UNSURE 1: Xaa = Lys,Thr
MFSLIIFFFPPSSPXANPFPSYLQNILYLKFVHXSHLYXXPPSECVHISSGLP

SEQ ID NO: 2313 - protein, 30 aa, Homo Sapiens
  Lymphocytes
  SIGNAL -23..-1: Von Heijne matrix; score 4.00; seq LHCLLIVFILVEF/CK
MSAFYLSYSLLHCLLIVFILVEFCKKLTYF

SEQ ID NO: 2314 - protein, 52 aa, Homo Sapiens
  Lymph ganglia
  SIGNAL -30..-1: Von Heijne matrix
  score 4.00
  seq SAGVVLTMDGASA/EQ
  UNSURE -14: Xaa = His,Gln
MAEAKLVQGSLVAPQRXSAGVVLTMDGASAEQDGLQEDRSHSGPSSLPEAHR

SEQ ID NO: 2315 - protein, 74 aa, Homo Sapiens [sequence omitted]

SEQ ID NO: 2316 - protein, 70 aa, Homo Sapiens
  Umbilical cord
  SIGNAL -45..-1: Von Heijne matrix; score 3.80; seq QLFWVTASTFCRS/DI
MLRKLSASNENLCLLSNPSHNEVYLIRCCESHQLFWVTASTFCRSDIATMASLLPSVLLMQLFSTFFLNL

SEQ ID NO: 2317 - protein, 18 aa, Homo Sapiens [sequence omitted]

SEQ ID NO: 2318 - protein, 67 aa, Homo Sapiens
  Lymph ganglia
  SIGNAL -23..-1: Von Heijne matrix; score 3.80; seq RGFVAVGLGQISA/SP
MLLRPSPGSPRGFVAVGLGQISASPSMACKLTILQHTSVFRVVVFRTPLVRGPLSRSNELWLHHLSS

SEQ ID NO: 2319 - protein, 25 aa, Homo Sapiens [sequence omitted]

SEQ ID NO: 2320 - protein, 23 aa, Homo Sapiens
  Umbilical cord
  SIGNAL -19..-1: Von Heijne matrix
  score 3.80
  seq LSLCIXXLEHLFT/WP
  UNSURE -8: Xaa = Leu,Trp
  UNSURE -7: Xaa = Ser,Thr
MEPVSSLSLCIXXLEHLFTWPKG

SEQ ID NO: 2321 - protein, 28 aa, Homo Sapiens [sequence omitted]

SEQ ID NO: 2322 - protein, 19 aa, Homo Sapiens [sequence omitted]

SEQ ID NO: 2323 - protein, 46 aa, Homo Sapiens
  Lymph ganglia
  SIGNAL -15..-1: Von Heijne matrix
  score 3.60
  seq LLHRAVVLRLQQA/CR
  UNSURE 31: Xaa = Ala,Asp,Glu,Gly
MLLLHRAVVLRLQQACRPTSLPDSSQSPQGSAFRPAPQMIHFSPLX

SEQ ID NO: 2324 - protein, 53 aa, Homo Sapiens
  Umbilical cord
  SIGNAL -32..-1: Von Heijne matrix
  score 3.60
  seq SLVPSMCFHVTNS/IK
  UNSURE -27: Xaa =  * ,Leu
  UNSURE -14: Xaa =  * ,Trp
  UNSURE -26: Xaa = Ile,Val
MEMFGXXEKDFSSVEGVLXSLVPSMCFHVTNSIKMPWFPSQPGTCTQKDCPPK

SEQ ID NO: 2325 - protein, 48 aa, Homo Sapiens
  Lymph ganglia
  SIGNAL -46..-1: Von Heijne matrix; score 3.60; seq LLGVHASFQMSVA/AR
MQMHGWRWDPHSSEQLDLAHTLSREASLENNTALLGVHASFQMSVAAR

SEQ ID NO: 2326 - protein, 37 aa, Homo Sapiens
  Lymphocytes
  SIGNAL -34..-1: Von Heijne matrix; score 3.60; seq VGTGVLTSRLARA/TP
MASPRGTDYNQTPNTTMYCYAVGTGVLTSRLARATPG

SEQ ID NO: 2327 - protein, 71 aa, Homo Sapiens
  Lymphocytes
  SIGNAL -42..-1: Von Heijne matrix; score 3.60; seq LHCLCPFPALFLS/VT
MAPILSSFKSLLKYHLLETSLSILLKPVTLHCLCPFPALFLSVTFIYLTYYIFNLYILFIVCLLYWNVLSM

SEQ ID NO: 2328 - protein, 31 aa, Homo Sapiens [sequence omitted]

SEQ ID NO: 2329 - protein, 32 aa, Homo Sapiens
  Lymph ganglia
  SIGNAL -29..-1: Von Heijne matrix; score 3.50; seq ALITILILYSSNS/AI
MSSNKEQRSAVFVILFALITILILYSSNSAIG

SEQ ID NO: 2330 - protein, 73 aa, Homo Sapiens
  Lymphocytes
  SIGNAL -68..-1: Von Heijne matrix; score 3.50; seq CLFLSPQSFLVLS/WA
MDMKSNTGHGLFLGRQPSFSVRSMPGTPALAICQPHNPGPPMGTPTEDPSGCSFPCLFLSPQSFLVLSWAISR

SEQ ID NO: 2331 - protein, 36 aa, Homo Sapiens [sequence omitted]

SEQ ID NO: 2332 - protein, 114 aa, Homo Sapiens
  Lymph ganglia
  SIGNAL -19..-1: Von Heijne matrix
  score 12.80
  seq XVFLVALLRGVQC/QV
  UNSURE -13: Xaa =  * ,Trp
  UNSURE -15: Xaa = Lys,Leu,Met,Gln
MESGXGXVFLVALLRGVQCQVQIVQSGGGVVQPGKSQTLSCVTYGFRFDDFGFHWVRQAPGKGLEWVAMIRYDGSNKFYSKSVQGRFLISRDNSRNQVYLSLNRLRVDDTAVYY

SEQ ID NO: 2333 - protein, 26 aa, Homo Sapiens
  Umbilical cord
  SIGNAL -17..-1: Von Heijne matrix
  score 9.30
  seq LFTLLLLQSLLLG/CC
  UNSURE 5: Xaa = Ile,Met
MLCRLFTLLLLQSLLLGCCIYXPGNG

SEQ ID NO: 2334 - protein, 97 aa, Homo Sapiens
  Lymph ganglia
  SIGNAL -26..-1: Von Heijne matrix; score 9.30; seq FLLLVAGPRWVLS/QV
MDLLHKNMKHLWFFLLLVAGPRWVLSQVRLEQWGSGLVKSSETLSLTCAVYGGSAISDYWAWIRQFPGKGVEWIGEINHSGATHYIRPSGVESPSPL

SEQ ID NO: 2335 - protein, 77 aa, Homo Sapiens
  Lymph ganglia
  SIGNAL -51..-1: Von Heijne matrix
  score 8.10
  seq VCLCGTFCFPCLG/CQ
  UNSURE 23: Xaa =  * ,Tyr
  UNSURE 25: Xaa = Ile,Asn,Thr
MQAQAPVVVVTQPGVGPGPAPQNSNWQTGMCDCFSDCGVCLCGTFCFPCLGCQVAADMNECCLCGTSVAMRTLXRXR

SEQ ID NO: 2336 - protein, 52 aa, Homo Sapiens
  Lymphocytes
  SIGNAL -18..-1: Von Heijne matrix; score 7.70; seq LLLLPVLGLLVSS/KT
MKALCLLLLPVLGLLVSSKTLCSMEEAINERIQEVAGSLIFRAISSIGRGSE

SEQ ID NO: 2337 - protein, 59 aa, Homo Sapiens
  Lymph ganglia
  SIGNAL -21..-1: Von Heijne matrix
  score 6.60
  seq LLXIVGLXLPTXG/QX
  UNSURE 2,7: Xaa = Ala,Thr
  UNSURE -2: Xaa = Ile,Arg,Ser
  UNSURE -6: Xaa = Ile,Lys,Met,Asn
  UNSURE -11: Xaa = Ile,Thr
MSPSGRLCLLXIVGLXLPTXGQXLKDTXSSSSADSTIMDIQVPTRAPDAVYTELQPTHG

SEQ ID NO: 2338 - protein, 56 aa, Homo Sapiens
  Lymph ganglia
  SIGNAL -21..-1: Von Heijne matrix; score 6.20; seq FLVSNMLLAEAYG/SG
MLLAWVQAFLVSNMLLAEAYGSGGCFWDNGHLYREDQTSPAPGLRCLNWLDAQNGL

SEQ ID NO: 2339 - protein, 132 aa, Homo Sapiens
  Lymph ganglia
  SIGNAL -62..-1: Von Heijne matrix
  score 5.80
  seq LXLTCSVSGGSIS/RT
  UNSURE 38: Xaa =  * ,Glu,Gly,Lys,Gln,Arg,Trp
  UNSURE -28: Xaa = Ala,Asp
  UNSURE 36: Xaa = Arg,Ser
  UNSURE -12: Xaa = Cys,Ser
  UNSURE -20: Xaa = Leu,Met,Val
  UNSURE 26: Xaa = Lys,Arg
  UNSURE 37: Xaa = any one of the twenty amino acids
MLSESRGPPVQEHEAPVVLPPAGGGSQMGPVPAAXAGESGPGXVKPLETLXLTCSVSGGSISRTSFYWGWIRQPPGKGLEWIGSIYDXGSTYYNPSLXXXVTISVDTSKNQVSLKVSSVTAADTAVYHCARG

SEQ ID NO: 2340 - protein, 137 aa, Homo Sapiens
  Lymph ganglia
  SIGNAL -108..-1: Von Heijne matrix
  score 5.30
  seq ACMTLTASPGVFP/SL
  UNSURE -99: Xaa = Phe,Ile,Ser,Thr
MTSGQARASXQSPQALEDSGPVNISVSITLTLDPLKPFGGYSRNVTHLYSTILGHQIGLSGREAHEEINITFTLPTAWSSDDCALHGHCEQVVFTACMTLTASPGVFPSLYSHRTVFLTRTATPRSGTRSSQLPEMP

SEQ ID NO: 2341 - protein, 48 aa, Homo Sapiens
  Lymph ganglia
  SIGNAL -21..-1: Von Heijne matrix; score 5.10; seq LLLKIWLLQRPES/QE
MLGGDHRALLLKIWLLQRPESQEGLLPGRLVVMERRVKNDLMSFLSTA

SEQ ID NO: 2342 - protein, 56 aa, Homo Sapiens
  Lymph ganglia
  SIGNAL -29..-1: Von Heijne matrix; score 4.60; seq SLMSLLDESSCQA/VG
MRFRKAWAPVLAALSHSLMSLLDESSCQAVGRPVEKLARNWWGPFPPIASKELNPA

SEQ ID NO: 2343 - protein, 105 aa, Homo Sapiens
  Lymph ganglia
  SIGNAL -82..-1: Von Heijne matrix; score 4.40; seq NLPHLQVVGLTWG/HI
MYVWPCAVVLAQYLWFHRRSLPGKAILEIGAGVSLPGILAAKCGAEVILSDSSELPHCLEVCRQSCQMNNLPHLQVVGLTWGHISWDLLALPPQDIILASDVFFE

SEQ ID NO: 2344 - protein, 126 aa, Homo Sapiens
  Umbilical cord
  SIGNAL -56..-1: Von Heijne matrix
  score 4.40
  seq LWKLALQSSSCLS/LF
  UNSURE -19: Xaa = Asp,Glu,Gly
  UNSURE -50: Xaa = Cys,Ser
  UNSURE 51: Xaa = Cys,Ser,Tyr
  UNSURE 35: Xaa = Glu,Gly
MLNPAQXDTMPCEYLSLDAMEKWIIFGFILCHGILNTXATALNLWKLALQSSSCLSLFRDEVFHIHKAAEDLFVNIRGYNKRINDIRECKXAAVSHAGSMHRERRKXLRSALKELATVLSDQPGLL

SEQ ID NO: 2345 - protein, 27 aa, Homo Sapiens [sequence omitted]

SEQ ID NO: 2346 - protein, 74 aa, Homo Sapiens
  Umbilical cord
  SIGNAL -67..-1: Von Heijne matrix; score 3.80; seq QVLDSVLVGPVPA/ER
MAKVQVNNVVVLDNPSPFYNPFQFEITFECIEDLSEDLEWKIIYVGSAESEEYDQVLDSVLVGPVPAERHMFVF

SEQ ID NO: 2347 - protein, 38 aa, Homo Sapiens
  Lymphocytes
  SIGNAL -21..-1: Von Heijne matrix; score 3.70; seq ETCALASHSGSSG/SK
MADVEDGEETCALASHSGSSGSKSGGDKMFSLKKWNAV

SEQ ID NO: 2348 - protein, 22 aa, Homo Sapiens [sequence omitted]

SEQ ID NO: 2349 - protein, 70 aa, Homo Sapiens
  Lymph ganglia
  SIGNAL -19..-1: Von Heijne matrix
  score 11.70
  seq VFCLLAVAPGAHS/QV
  UNSURE -14,13: Xaa = Arg,Thr
  UNSURE 10: Xaa = Glu,Gln
  UNSURE 8,44: Xaa = Gly,Arg
  UNSURE 39: Xaa = His,Gln
MDWTWXVFCLLAVAPGAHSQVQLVQSXAXVRXPGASVKVSCKPSGYSFTSHYVHWVRXDPGQXLEWMGDG

SEQ ID NO: 2350 - protein, 75 aa, Homo Sapiens
  Umbilical cord
  SIGNAL -33..-1: Von Heijne matrix; score 10.90; seq LVSLLLLLTRVQP/GT
MDNSWRLGPAIGLSAGQSQLLVSLLLLLTRVQPGTDVAAPEHISYVPQLSNDTLAGRLTLSTFTLEQPLGQFSSR

SEQ ID NO: 2351 - protein, 95 aa, Homo Sapiens
  Lymph ganglia
  SIGNAL -19..-1: Von Heijne matrix
  score 10.90
  seq FLLLVAAPRWVLS/QV
  UNSURE 61: Xaa =  * ,Ala,Glu,Ile,Lys,Leu,Ser,Thr,Val
  UNSURE 22: Xaa =  * ,Cys
  UNSURE 69: Xaa = Ala,Pro,Ser,Thr
  UNSURE 73: Xaa = Ala,Val
  UNSURE 40: Xaa = Arg,Ser
  UNSURE 49: Xaa = Arg,Trp
  UNSURE 67: Xaa = Asp,Glu
  UNSURE 16: Xaa = Glu,Gln
  UNSURE 62: Xaa = Glu,Lys
  UNSURE -18: Xaa = Lys,Arg
  UNSURE -15: Xaa = Ser,Trp
MXHLXFFLLLVAAPRWVLSQVLLQESGPELVKPSXTLSLTXAVSGGSISGGPYYWNWVXQHPGKGLEXIGNIYYNGSTFXXPVPQXSXYHIXRRR

SEQ ID NO: 2352 - protein, 85 aa, Homo Sapiens
  Lymph ganglia
  SIGNAL -28..-1: Von Heijne matrix
  score 9.60
  seq LLTLLLGLTEVAG/EE
  UNSURE 57: Xaa = His,Ile,Lys,Leu,Met,Asn,Pro,Gln,Arg,Ser,Thr
MPVPASWPHPPGPFLLLTLLLGLTEVAGEEELQMIQPEKLLLVTVGKTATLHCTVTSLLPVGPVLWFRGVGPGRELIYNQKEGLX

SEQ ID NO: 2353 - protein, 38 aa, Homo Sapiens
  Umbilical cord
  SIGNAL -15..-1: Von Heijne matrix; score 9.60; seq EYVLLLFLALCSA/KP
MKEYVLLLFLALCSAKPFFSPSHIALKNMMLKDMEDTE

SEQ ID NO: 2354 - protein, 39 aa, Homo Sapiens
  Lymph ganglia
  SIGNAL -17..-1: Von Heijne matrix; score 9.30; seq LALSLLILVLAFG/IP
MAQSLALSLLILVLAFGIPRTQGSDGGAQDCCLKYSQTR

SEQ ID NO: 2355 - protein, 83 aa, Homo Sapiens
  Lymph ganglia
  SIGNAL -17..-1: Von Heijne matrix
  score 8.20
  seq LLLITAILAVAVG/FP
  UNSURE 7: Xaa = His,Gln
MKKVLLLITAILAVAVGFPVSQDXEREKRSISDSDELASGFFVFPYPYPFRPLPPIPFPRFPWFRRNFPIPIPESAPTTPLPM

SEQ ID NO: 2356 - protein, 78 aa, Homo Sapiens
  Lymph ganglia
  SIGNAL -17..-1: Von Heijne matrix
  score 8.20
  seq LLLITAILAVAVG/FP
  UNSURE 50: Xaa = Lys,Asn
  UNSURE 24: Xaa = Phe,Ile
MKKVLLLITAILAVAVGFPVSQDQEREKRSISDSDELASGXFVFPYPYPFRPLPPIPFPRFPWFRRXFPIPIPESAPG

SEQ ID NO: 2357 - protein, 51 aa, Homo Sapiens
  Placenta
  SIGNAL -18..-1: Von Heijne matrix; score 8.10; seq LFTAILAFSLAQS/FG
MRIMLLFTAILAFSLAQSFGAVCKEPQEEVVPGGGRSKRDPDLYQLLQRPW

SEQ ID NO: 2358 - protein, 125 aa, Homo Sapiens
  Lymph ganglia
  SIGNAL -17..-1: Von Heijne matrix
  score 7.90
  seq VLLLGLLSHCTVS/VS
  UNSURE 90: Xaa =  * ,Glu,Lys,Gln
  UNSURE 88: Xaa = Asn,Tyr
MAWTVLLLGLLSHCTVSVSSYELTQPPSVSVAPGETATISCGANNVGRKNVQWYQQKAGQAPVLVIYHDVERPSGIPERFSGSNSGSPAKLTISRVEAGDEADYXCXVWDSDSDHTVIFGGGTKL

SEQ ID NO: 2359 - protein, 82 aa, Homo Sapiens
  Lymph ganglia
  SIGNAL -58..-1: Von Heijne matrix
  score 7.70
  seq PXLLLQTLPASTX/XP
  UNSURE -51: Xaa =  * ,Glu
  UNSURE -29: Xaa = Ala,Gly,Val
  UNSURE -17: Xaa = Ala,Leu,Pro,Ser,Val
  UNSURE -12: Xaa = Ala,Thr
  UNSURE -31: Xaa = Asn,Thr
  UNSURE -25: Xaa = Gly,Val
  UNSURE 1: Xaa = His,Gln
  UNSURE -1,8: Xaa = Pro,Thr
MTILHTGXNPFRPSQRWTAPALLHHRPXTXPPSXHRSRCTEXVGIPXLLLQTLPASTXXPQAFRRXSDPPAKPPQIYYRVQH

SEQ ID NO: 2360 - protein, 115 aa, Homo Sapiens
  Lymph ganglia
  SIGNAL -20..-1: Von Heijne matrix
  score 7.20
  seq LLLLVAAPKXXLS/QV
  UNSURE -4: Xaa = Cys,Phe
  UNSURE 58: Xaa = Ile,Val
  UNSURE -3: Xaa = Phe,Val
MKHLWFFLLLLVAAPKXXLSQVQLRESGPGLVEPSQTLSLTCSVSRGSVNSGGYYWSWIRQHPGKGLEWIGYVYYGGXTYYNPSLKSRVTLSADTSKNQFFLRLTSMTAADTASG

SEQ ID NO: 2361 - protein, 43 aa, Homo Sapiens [sequence omitted]

SEQ ID NO: 2362 - protein, 57 aa, Homo Sapiens
  Umbilical cord
  SIGNAL -42..-1: Von Heijne matrix; score 6.40; seq ELPALALLHAGHA/EP
MGTQDPQAEQGLRIPLPGLLLSKHHHPAPELPALALLHAGHAEPAQDGEPGHPRGPG

SEQ ID NO: 2363 - protein, 76 aa, Homo Sapiens
  Lymph ganglia
  SIGNAL -33..-1: Von Heijne matrix
  score 6.30
  seq SXXPLXSVQLXHA/QR
  UNSURE -8: Xaa =  * ,Leu
  UNSURE -3: Xaa = Arg,Trp
  UNSURE -12,-11: Xaa = Phe,Leu
MMTIYALSNEFAFKINEEQLSXXPLXSVQLXHAQRFLLDSSWSGVIPFFFSCSCLPFLYPPKWRQIHDLKDTQYRS

SEQ ID NO: 2364 - protein, 26 aa, Homo Sapiens
  Lymphocytes
  SIGNAL -21..-1: Von Heijne matrix
  score 6.10
  seq LEMLTAFASHIRA/RD
  UNSURE -15: Xaa = Ile,Thr
MRGAHLXALEMLTAFASHIRARDAAR

SEQ ID NO: 2365 - protein, 71 aa, Homo Sapiens [sequence omitted]

SEQ ID NO: 2366 - protein, 33 aa, Homo Sapiens
  Umbilical cord
  SIGNAL -19..-1: Von Heijne matrix; score 6.10; seq IILLIHTMQVCTT/HP
MMTQTCIILLIHTMQVCTTHPTVLSHTLLQRPM

SEQ ID NO: 2367 - protein, 82 aa, Homo Sapiens
  Lymph ganglia
  SIGNAL -25..-1: Von Heijne matrix
  score 6.00
  seq LLGLLVAVATVHL/VI
  UNSURE 43: Xaa = Cys,Phe,Tyr
MAGKGSSGRRPLLLGLLVAVATVHLVICPYTKVEESFNLQATHDLLYHWQDLEQYDHLEFPGVVPRTXLGPVVIAVFSSPAV

SEQ ID NO: 2368 - protein, 124 aa, Homo Sapiens
  Lymph ganglia
  SIGNAL -22..-1: Von Heijne matrix
  score 5.90
  seq LIYILWQLTGSAA/SG
  UNSURE 79: Xaa = Asp,Glu,Gly
  UNSURE 47: Xaa = Ile,Asn,Thr
  UNSURE 94: Xaa = Phe,Ser
MAGSPTCLTLIYILWQLTGSAASGPVKELVGSVGGAVTFPLKSKVKQVDSIVWTFNTTPLVTIQPEGGXIIVTQNRNRERVDFPDGGYSLKLSKLKKNDSXIYYVGIYSSSLQQPXTQEYVLHV

SEQ ID NO: 2369 - protein, 21 aa, Homo Sapiens [sequence omitted]

SEQ ID NO: 2370 - protein, 116 aa, Homo Sapiens
  Umbilical cord
  SIGNAL -13..-1: Von Heijne matrix
  score 5.70
  seq MXLLHSLSSGVRA/PS
  UNSURE 83: Xaa = Ala,Pro,Thr
  UNSURE 102: Xaa = Asp,Glu
  UNSURE -12: Xaa = Leu,Pro,Arg
MXLLHSLSSGVRAPSPAPSSVPLGSEKPSNVSQDRKVPVPIGTERSARIRQTGTSAPSVIGSNLSTSVGHSGIWSFEGIGGNQDKVDWCNPGMGNXMIHRPMSDPGVFSQHQATXA

SEQ ID NO: 2371 - protein, 24 aa, Homo Sapiens
  Lymph ganglia
  SIGNAL -19..-1: Von Heijne matrix; score 5.60; seq PTLCVSSSPALWA/AS
MTMAECPTLCVSSSPALWAASETG

SEQ ID NO: 2372 - protein, 133 aa, Homo Sapiens
  Umbilical cord
  SIGNAL -25..-1: Von Heijne matrix; score 5.50; seq AQLFACLLRLGTQ/QV
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNQTRLHHTDDDG

SEQ ID NO: 2373 - protein, 101 aa, Homo Sapiens
  Umbilical cord
  SIGNAL -86..-1: Von Heijne matrix
  score 5.50
  seq ALLTGPTLGSSQA/RW
  UNSURE -19: Xaa = Ala,Pro
  UNSURE 5: Xaa = Lys,Gln
MSEMAELSELYEESSDLQMDVMPGEGDLPQMEVGSGSRELSLRPSRSGAQQLEEEGPMEEEEAQPMAXQRGNGALLTGPTLGSSQARWRAXTSRARTRAPG

SEQ ID NO: 2374 - protein, 37 aa, Homo Sapiens
  Lymph ganglia
  SIGNAL -15..-1: Von Heijne matrix
  score 5.30
  seq IVSVLALIPXTTT/LT
  UNSURE -4: Xaa = Asp,Glu
  UNSURE 10: Xaa = Phe,Ile,Leu
MLIVSVLALIPXTTTLTVGGGVFAXVTAVCCLADGGG

SEQ ID NO: 2375 - protein, 50 aa, Homo Sapiens
  Lymph ganglia
  SIGNAL -29..-1: Von Heijne matrix; score 5.00; seq ELSLLPSSLWVLA/TS
MTCRGSCSYATRRSPSELSLLPSSLWVLATSSPTITIALAMAAGNLCPLR

SEQ ID NO: 2376 - protein, 58 aa, Homo Sapiens
  Umbilical cord
  SIGNAL -15..-1: Von Heijne matrix
  score 4.90
  seq AVVFVFSLLDCCA/LI
  UNSURE 14: Xaa = Asp,Asn
MEAVVFVFSLLDCCALIFLSVYFIITLSXLECDYINARSCCSKLNKWVIPELIGHTIG

SEQ ID NO: 2377 - protein, 57 aa, Homo Sapiens
  Lymph ganglia
  SIGNAL -30..-1: Von Heijne matrix; score 4.90; seq VAHALSLPAQSYG/ND
MAATSGTDEPVSGELVSVAHALSLPAQSYGNDPDIEMAWAMRAMQHAEVYYKLISSV

SEQ ID NO: 2378 - protein, 44 aa, Homo Sapiens
  Lymph ganglia
  SIGNAL -17..-1: Von Heijne matrix
  score 4.60
  seq ALFLLLHNEMVSG/VY
  UNSURE 7: Xaa = Arg,Thr
  UNSURE 6: Xaa = Asp,Glu
MADEALFLLLHNEMVSGVYKSAXXGRWKTDDVLLSWKTWGFEWD

SEQ ID NO: 2379 - protein, 126 aa, Homo Sapiens
  Lymphocytes
  SIGNAL -119..-1: Von Heijne matrix; score 4.30; seq SVCLSIISMLSSC/KE
MASMQKRLQKELLALQNDPPPGMTLNEKSVQNSITQWIVDMEGAPGTLYEGEKFQLLFKFSSRYPFDSPQVMFTGENIPVHPHVYSNGHICLSILTEDWSPALSVQSVCLSIISMLSSCKEKRRPP

SEQ ID NO: 2380 - protein, 59 aa, Homo Sapiens
  Lymph ganglia
  SIGNAL -27..-1: Von Heijne matrix
  score 4.10
  seq VLMFCVTPPELET/KX
  UNSURE -25: Xaa = Ile,Lys,Asn,Arg,Ser
  UNSURE 2: Xaa = Met,Val
  UNSURE 13: Xaa = Ser,Thr
MKXMTGSENWKTKKVLMFCVTPPELETKXNITKGGLVLFXANSNSSCMELSKKIAERPA

SEQ ID NO: 2381 - protein, 39 aa, Homo Sapiens
  Lymphocytes
  SIGNAL -33..-1: Von Heijne matrix; score 4.10; seq LFMTRTLCSPGPS/QP
MQHIVGVPHVLVRRGLLGRDLFMTRTLCSPGPSQPREAG

SEQ ID NO: 2382 - protein, 68 aa, Homo Sapiens
  Lymph ganglia
  SIGNAL -19..-1: Von Heijne matrix; score 3.80; seq ALALASSQSHLLG/RD
MYHQSEALALASSQSHLLGRDSPSAVFEQDLENKEMSKEWFLFNDSRVTFTSFQSVQKITSRFPKDTW

SEQ ID NO: 2383 - protein, 54 aa, Homo Sapiens
  Umbilical cord
  SIGNAL -22..-1: Von Heijne matrix
  score 3.80
  seq FASVAMICAIASG/SE
  UNSURE 8: Xaa =  * ,Asp,Glu,His,Gln,Tyr
MSGQGLAGFFASVAMICAIASGSELSESAXGYFITACAVIILTIICYLGLPRQG

SEQ ID NO: 2384 - protein, 50 aa, Homo Sapiens
  Lymph ganglia
  SIGNAL -30..-1: Von Heijne matrix
  score 3.70
  seq SMMLLTVYGGYLC/SV
  UNSURE 18: Xaa = Ala,Glu
  UNSURE 16: Xaa = His,Gln
MPTGKQLADIGYKTFSTSMMLLTVYGGYLCSVRVYHYFQWRRAQRXAXEG

SEQ ID NO: 2385 - protein, 18 aa, Homo Sapiens
  Lymph ganglia
  SIGNAL -14..-1: Von Heijne matrix
  score 3.50
  seq FPVCLTVTAAVCG/XX
  UNSURE 2: Xaa = His,Gln
  UNSURE 1: Xaa = Leu,Pro,Gln,Arg
MFPVCLTVTAAVCGXXAQ

SEQ ID NO: 2386 - protein, 49 aa, Homo Sapiens
  Lymph ganglia
  SIGNAL -15..-1: Von Heijne matrix; score 3.50; seq VIFFACVVRVRDG/LP
MSVIFFACVVRVRDGLPLSASTDFYHTQDFLEWRRRLKSLALRLAQYPG

SEQ ID NO: 2387 - protein, 89 aa, Homo Sapiens
  Lymphocytes
  SIGNAL -68..-1: Von Heijne matrix
  score 3.50
  seq LVLDVVMLLLYLG/IE
  UNSURE -66: Xaa = Lys,Arg,Thr
MLXGGLKMAPRGKRLSSTPLEILFFLNGWYNATYFLLELFIFLYKGVLLPYPTANLVLDVVMLLLYLGIEVIRLFFGTKGNLCQRKMPR

SEQ ID NO: 2388 - protein, 65 aa, Homo Sapiens [sequence omitted]

SEQ ID NO: 2389 - protein, 57 aa, Homo Sapiens
  Lymph ganglia
  SIGNAL -28..-1: Von Heijne matrix
  score 8.40
  seq LLRLLCLLPTGLP/VR
  UNSURE 27: Xaa = Ala,Asp,Gly,His,Ile,Leu,Asn,Pro,Arg,Ser,Thr,Val
MVRRVQPDRKQLPLVLLRLLCLLPTGLPVRSVDFNRGTDNITVRQGDTAILRFLXSG

SEQ ID NO: 2390 - protein, 51 aa, Homo Sapiens
  Lymph ganglia
  SIGNAL -19..-1: Von Heijne matrix
  score 7.40
  seq LVFIIGLVGNLLA/LV
  UNSURE 29: Xaa = Ser,Thr
MPLHYSLVFIIGLVGNLLALVVIVQNRKKINSTTLYSTNLVISDILFXTVG

SEQ ID NO: 2391 - protein, 71 aa, Homo Sapiens
  Umbilical cord
  SIGNAL -30..-1: Von Heijne matrix
  score 6.50
  seq WATLGLLVAGLGG/HD
  UNSURE 37: Xaa = Asn,Thr
  UNSURE 28: Xaa = His,Gln
MARGLGAPHWVAVGLLTWATLGLLVAGLGGHDDLHDDLQEDFHGHSHRHSHEDFHHGXSHAHGHGHXHESM

SEQ ID NO: 2392 - protein, 35 aa, Homo Sapiens
  Cancerous prostate
  SIGNAL -23..-1: Von Heijne matrix; score 11.40; seq VLALLLFVHYSNG/DE
MVFVHLYLGNVLALLLFVHYSNGDESSDPGPQHRA

SEQ ID NO: 2393 - protein, 34 aa, Homo Sapiens [sequence omitted]

SEQ ID NO: 2394 - protein, 37 aa, Homo Sapiens
  Normal prostate
  SIGNAL -26..-1: Von Heijne matrix; score 11.00; seq VLFLFLFWGVSLA/GS
MAVRELCFSRQRQVLFLFLFWGVSLAGSGFGRYSVTG

SEQ ID NO: 2395 - protein, 69 aa, Homo Sapiens
  Hypertrophic prostate
  SIGNAL -18..-1: Von Heijne matrix; score 10.70; seq LILLALATGLVGG/ET
MRILQLILLALATGLVGGETRIIKGFECKPHSQPWQAALFEKTRLLCGATLIAPRWLLTAAHCLKPRYG

SEQ ID NO: 2396 - protein, 57 aa, Homo Sapiens
  Hypertrophic prostate
  SIGNAL -18..-1: Von Heijne matrix
  score 10.70
  seq LILLALATGLVGG/ET
  UNSURE 14: Xaa = Cys,Phe,Ser,Tyr
MRILQLILLALATGLVGGETRIIKGFECKPHXQPWQAALFEKTRLLCGATLIAPRWL

SEQ ID NO: 2397 - protein, 103 aa, Homo Sapiens
  Hypertrophic prostate
  SIGNAL -30..-1: Von Heijne matrix
  score 10.60
  seq SLLLAVLVFFLFA/LP
  UNSURE 4: Xaa =  * ,Ala,Cys,Asp,Glu,Phe,Gly,Ile,Lys,Leu,Asn,Arg,Ser,Thr,Val,Tyr
  UNSURE 7: Xaa =  * ,Cys,Gly,Trp
  UNSURE 6: Xaa =  * ,Trp
  UNSURE 8: Xaa = Ala,Pro
  UNSURE 5: Xaa = Asn,Ser,Thr
  UNSURE 27: Xaa = Leu,Gln
MRSCLWRCRHLSQGVQWSLLLAVLVFFLFALPSXXXXXQTKPSRHQRTENIKERSLXSLAKPKSQAPTRARRTTIYAEPVPENNALNTQTQPKAHTTGDRRKG

SEQ ID NO: 2398 - protein, 80 aa, Homo Sapiens
  Cancerous prostate
  SIGNAL -18..-1: Von Heijne matrix
  score 10.60
  seq XILLALATGLVGG/EI
  UNSURE -13: Xaa =  * ,Leu
MRILQXILLALATGLVGGEIRIIKGFECKPHSQPWQAALFEKTRLLLWGDAHRPQMAPDSSPLPQAPLHSSPGAAQPPEG

SEQ ID NO: 2399 - protein, 51 aa, Homo Sapiens
  Normal prostate
  SIGNAL -38..-1: Von Heijne matrix
  score 10.40
  seq LWLLLKLVSTXWA/VR
  UNSURE -3: Xaa = Pro,Ser
MLEECGAGVDLGFGGVKFASETPNLLWLLLKLVSTXWAVRVTLIIFNNQAR

SEQ ID NO: 2400 - protein, 27 aa, Homo Sapiens
  Normal prostate
  SIGNAL -23..-1: Von Heijne matrix; score 10.20; seq RCLLLALVAESSS/QT
MIACSIRELHRCLLLALVAESSSQTHG

SEQ ID NO: 2401 - protein, 32 aa, Homo Sapiens
  Cancerous prostate
  SIGNAL -17..-1: Von Heijne matrix; score 10.20; seq SLVLCLLSATVFS/LQ
MGPPSLVLCLLSATVFSLQGGSSAFLSHHRPG

SEQ ID NO: 2402 - protein, 112 aa, Homo Sapiens
  Hypertrophic prostate
  SIGNAL -35..-1: Von Heijne matrix
  score 9.00
  seq AMWWLLLWGVLQX/XP
  UNSURE -1: Xaa = Ala,Gly
  UNSURE 11: Xaa = Leu,Pro,Gln
  UNSURE 1: Xaa = Leu,Trp
MPGPRVWGKYLWRSPHSKGCPGAMWWLLLWGVLQXXPNPGLRPLGXRATPAADIPRVPRAVWQRPREQHGHQGSRGLCCEARLPGLRPGAVPGLCRGLCHNLIRRFGSKPLG

SEQ ID NO: 2403 - protein, 100 aa, Homo Sapiens
  Normal prostate
  SIGNAL -22..-1: Von Heijne matrix
  score 8.80
  seq LLTLALLGGPTWX/XK
  UNSURE -1: Xaa = Ala,Glu
  UNSURE 1: Xaa = Gly,Arg
  UNSURE 31: Xaa = Leu,Arg
MHRPEAMLLLLTLALLGGPTWXXKMYGPGGGKYFSTTEDYDHEITGLRVSVGXLLVKSVQVKLGDSWDVKLGGLRWEYPGSHPAARRIHHKSLCRFQAFL

SEQ ID NO: 2404 - protein, 59 aa, Homo Sapiens
  Prostate
  SIGNAL -15..-1: Von Heijne matrix; score 8.60; seq SVSLALLSGWVGS/RQ
MVSVSLALLSGWVGSRQGGVGLSTLVTLGLVSWCWRMVRTQALEGFLSVKYYSAFSADL

SEQ ID NO: 2405 - protein, 55 aa, Homo Sapiens
  Prostate
  SIGNAL -49..-1: Von Heijne matrix
  score 8.50
  seq IVFLLLRVSPCLG/PS
  UNSURE -40: Xaa = Cys,Ser
  UNSURE 3: Xaa = His,Gln
MHIFSICCMXSELHKMKSLSLQLASEKRSLVALVEEIVFLLLRVSPCLGPSXKPR

SEQ ID NO: 2406 - protein, 22 aa, Homo Sapiens
  Normal prostate
  SIGNAL -17..-1: Von Heijne matrix; score 8.30; seq VSALLMAWFGVLS/CV
MKLWVSALLMAWFGVLSCVQTG

SEQ ID NO: 2407 - protein, 48 aa, Homo Sapiens
  Normal prostate
  SIGNAL -22..-1: Von Heijne matrix
  score 8.30
  seq LLLPLMLMSMVSS/SL
  UNSURE 3: Xaa = Ile,Asn
MKVLISSLLLLLPLMLMSMVSSSLXPGVARGHRDRGQASRRWLQEGGL

SEQ ID NO: 2408 - protein, 69 aa, Homo Sapiens
  Cancerous prostate
  SIGNAL -22..-1: Von Heijne matrix; score 8.30; seq LLLPLMLMSMVSS/SL
MKVLISSLLLLLPLMLMSMVSSSLNPGVARGHRDRGQASRRWLQEGGQECECKDWFLRAPRRKFMTVSG

SEQ ID NO: 2409 - protein, 16 aa, Homo Sapiens
  Cancerous prostate
  SIGNAL -14..-1: Von Heijne matrix; score 8.20; seq LLLLQLSLPSPTS/SP
MLLLLQLSLPSPTSSP

SEQ ID NO: 2410 - protein, 27 aa, Homo Sapiens
  Normal prostate
  SIGNAL -17..-1: Von Heijne matrix; score 8.10; seq LSFKLLLLAVALG/FF
MLKMLSFKLLLLAVALGFFEGDAKFGE

SEQ ID NO: 2411 - protein, 69 aa, Homo Sapiens
  Hypertrophic prostate
  SIGNAL -22..-1: Von Heijne matrix
  score 8.00
  seq LLTLALLGXXXWA/GK
  UNSURE -3: Xaa = Asn,Thr
  UNSURE -5: Xaa = Asp,Gly
  UNSURE -4: Xaa = Pro,Thr
MHRPEAMLLLLTLALLGXXXWAGKMYGPGGGKYFSTTEDYDHEITGLRVSVGLLLVKSVQVKLGDSWDV

SEQ ID NO: 2412 - protein, 70 aa, Homo Sapiens
  Normal prostate
  SIGNAL -16..-1: Von Heijne matrix; score 8.00; seq VSAVLCVCAAAWC/SQ
MLKVSAVLCVCAAAWCSQSLAAAAAVAAAGGRSDGGNFLDDKQWLTTISQYDKEVGQWNKFRDDDYFRTG

SEQ ID NO: 2413 - protein, 45 aa, Homo Sapiens
  Normal prostate
  SIGNAL -17..-1: Von Heijne matrix; score 7.80; seq VLWLISFFTFTDG/HG
MKVGVLWLISFFTFTDGHGGFLGKNDGIKTKKELIVNKKKHLGLG

SEQ ID NO: 2414 - protein, 19 aa, Homo Sapiens
  Normal prostate
  SIGNAL -16..-1: Von Heijne matrix; score 7.70; seq ILLDLICLLFITA/CV
MCIILLDLICLLFITACVG

SEQ ID NO: 2415 - protein, 62 aa, Homo Sapiens [sequence omitted]

SEQ ID NO: 2416 - protein, 57 aa, Homo Sapiens
  Hypertrophic prostate
  SIGNAL -20..-1: Von Heijne matrix
  score 7.60
  seq LVVLFGITAGATG/AK
  UNSURE 32: Xaa =  * ,Cys,Arg,Ser,Trp
  UNSURE 31: Xaa =  * ,Gly,Leu,Arg,Val
MTASPDYLVVLFGITAGATGAKLGSDEKELILLFWKVVDLANKKVGQLHEXXLDRIW

SEQ ID NO: 2417 - protein, 79 aa, Homo Sapiens
  Normal prostate
  SIGNAL -15..-1: Von Heijne matrix; score 7.60; seq CVLVLAAAAGAVA/VF
MVCVLVLAAAAGAVAVFLILRIWVVLRSMDVTPRESLSILVVAGSGGHTTEILRLLGSLSNAYSPRHYVIADTDEMSAT

SEQ ID NO: 2418 - protein, 82 aa, Homo Sapiens [sequence omitted]

SEQ ID NO: 2419 - protein, 103 aa, Homo Sapiens
  Normal prostate
  SIGNAL -23..-1: Von Heijne matrix
  score 7.50
  seq LTFLQLLLISSLP/RE
  UNSURE 50: Xaa = Ala,Glu
  UNSURE 16: Xaa = Asn,Thr
  UNSURE 69: Xaa = Lys,Thr
MELGCWTQLGLTFLQLLLISSLPREYTVINEACPGAEWXIMCRECCEYDQIECVCPGKREVVGYTIPCCRNEXNECDSCLIHPGCTIFENCXSCRNGSWGGTL

SEQ ID NO: 2420 - protein, 80 aa, Homo Sapiens
  Hypertrophic prostate
  SIGNAL -27..-1: Von Heijne matrix
  score 7.20
  seq SLLFFLLLEGGXT/EQ
  UNSURE -2: Xaa =  * ,Glu
  UNSURE 43: Xaa = Asp,Asn
  UNSURE -25: Xaa = Glu,Lys
  UNSURE 4: Xaa = Lys,Asn,Thr
MRXKWKMGGMKYIFSLLFFLLLEGGXTEQVXHSETYCMFQDKKYRVGERWHPYLEPYGLVYCVNCICSEXGNVLCSRVRC

SEQ ID NO: 2421 - protein, 81 aa, Homo Sapiens
  Hypertrophic prostate
  SIGNAL -19..-1: Von Heijne matrix; score 7.20; seq VSIMLLLVTVSDC/AV
MRGATRVSIMLLLVTVSDCAVITGACERDVQCGAGTCCAISLWLRGLRMCTPLGREGEECHPGSHKIPFFRKRKHHTCPCL

SEQ ID NO: 2422 - protein, 47 aa, Homo Sapiens
  Normal prostate
  SIGNAL -21..-1: Von Heijne matrix
  score 7.20
  seq SALLFSLLCEAST/VV
  UNSURE 17: Xaa = Ala,Thr
  UNSURE 19: Xaa = Ile,Asn
  UNSURE 12: Xaa = Pro,Arg
MIAISAVSSALLFSLLCEASTVVLLNSTDSSPXTNNFXDXEAALKAH

SEQ ID NO: 2423 - protein, 85 aa, Homo Sapiens
  Hypertrophic prostate
  SIGNAL -21..-1: Von Heijne matrix
  score 7.20
  seq SALLFSLLCEAST/VV
  UNSURE 63: Xaa = Pro,Thr
MIAISAVSSALLFSLLCEASTVVLLNSTDSSPPTNNFTDIEAALKAQLDSADIPKARRKRYISQNDMIAILDYHNQVRGKVFPXA

SEQ ID NO: 2424 - protein, 25 aa, Homo Sapiens
  Cancerous prostate
  SIGNAL -22..-1: Von Heijne matrix; score 7.20; seq LLTLVLCVAVAYE/RQ
MDPNGGCCTLLTLVLCVAVAYERQE

SEQ ID NO: 2425 - protein, 34 aa, Homo Sapiens [sequence omitted]

SEQ ID NO: 2426 - protein, 45 aa, Homo Sapiens
  Normal prostate
  SIGNAL -41..-1: Von Heijne matrix; score 7.00; seq FLCMLAAIDLALS/TS
MYVVAMFGNCIVVFIVRTERSLHAPMYLFLCMLAAIDLALSTSTM

SEQ ID NO: 2427 - protein, 63 aa, Homo Sapiens
  Normal prostate
  SIGNAL -43..-1: Von Heijne matrix
  score 7.00
  seq PWFLAPWCPGTQS/NR
  UNSURE -39: Xaa = Asn,Thr
MRETXPLPKPLKDTAPSSHGVGSDSPSATRPWFLAPWCPGTQSNRICHPPLSSPPDQATCLRG

SEQ ID NO: 2428 - protein, 93 aa, Homo Sapiens
  Normal prostate
  SIGNAL -60..-1: Von Heijne matrix
  score 7.00
  seq VLVVLALRSLGRS/CS
  UNSURE 30: Xaa =  * ,Tyr
MDRPGSLSVFGSLPASLGTWLSSPAWLVDRPVRSAHPSANSTGVRMSVLVVLALRSLGRSCSLSQAAPSRWTRSNDAPQPPGSQHIFHTXVPG

SEQ ID NO: 2429 - protein, 36 aa, Homo Sapiens
  Normal prostate
  SIGNAL -21..-1: Von Heijne matrix
  score 7.00
  seq VILLFSYPSCCLC/FL
  UNSURE 9: Xaa = Asn,Tyr
MHYFVAGKVILLFSYPSCCLCFLVYRRVSXLFKCFE

SEQ ID NO: 2430 - protein, 53 aa, Homo Sapiens
  Cancerous prostate
  SIGNAL -19..-1: Von Heijne matrix; score 7.00; seq STVVLQVLTQATS/QD
MDLNSASTVVLQVLTQATSQDTAVLKPAEEQLKQWETQPGFYSVLLNIFTNHG

SEQ ID NO: 2431 - protein, 77 aa, Homo Sapiens
  Normal prostate
  SIGNAL -73..-1: Von Heijne matrix; score 7.00; seq FLCMLAAIDLALS/TS
MSSCNFTHATFVLIGIPGLEKAHFWVGFPLLSMYVVAMFGNCIVVFIVRTERSLHAPMYLFLCMLAAIDLALSTSTM

SEQ ID NO: 2432 - protein, 79 aa, Homo Sapiens
  Cancerous prostate
  SIGNAL -56..-1: Von Heijne matrix; score 6.90; seq PLFFSCSISATHS/CV
MYRLSLIAGPGSYPVLRWGVWDIPSSLVQVTYHQPNLTTNLDLPLFFSCSISATHSCVKPPSVIIGISSFLSFPYQTLV

SEQ ID NO: 2433 - protein, 91 aa, Homo Sapiens
  Normal prostate
  SIGNAL -24..-1: Von Heijne matrix; score 6.90; seq LCFLLLAVAMSFF/GS
MLVDGPSERPALCFLLLAVAMSFFGSALSIDETRAHLLLKEKMMRLGGRLVLNTKEELANERLMTLKIAEMKEAMRTLIFPPSMHFFQAKW

SEQ ID NO: 2434 - protein, 60 aa, Homo Sapiens
  Cancerous prostate
  SIGNAL -35..-1: Von Heijne matrix
  score 6.90
  seq XLXXLLTPPPSYG/HQ
  UNSURE 11: Xaa = Ala,Ser,Thr
  UNSURE -13,-11: Xaa = Ala,Val
  UNSURE -10: Xaa = Asp,Glu
  UNSURE -20: Xaa = Cys,Gly
  UNSURE -19: Xaa = His,Gln
  UNSURE -16: Xaa = Leu,Pro
MPCSLTWRLPPRTCQXXGLXKSXLXXLLTPPPSYGHQPQTGSGESXGASGDKDHLYSTVC

SEQ ID NO: 2435 - protein, 85 aa, Homo Sapiens
  Normal prostate
  SIGNAL -41..-1: Von Heijne matrix
  score 6.80
  seq LFLFLTSIAEXCS/TP
  UNSURE -16: Xaa = Asp,Glu
  UNSURE -26: Xaa = Cys,Phe,Gly,Val
  UNSURE -3: Xaa = Cys,Tyr
  UNSURE -39: Xaa = Phe,Ile,Val
  UNSURE 8: Xaa = Phe,Leu
MVXWLVLFALQIYSYXSTRDQPASRXRLLFLFLTSIAEXCSTPYSLLGXVFTVSFVALGVLTLCKFYLQGYRAFMNDPAMNRGGA

SEQ ID NO: 2436 - protein, 20 aa, Homo Sapiens
  Hypertrophic prostate
  SIGNAL -18..-1: Von Heijne matrix
  score 6.70
  seq LPLLXXXSLPVGA/WL
  UNSURE -8: Xaa =  * ,Leu,Gln
  UNSURE -9: Xaa = His,Leu,Pro,Gln
  UNSURE -7: Xaa = Leu,Met
MARHGLPLLXXXSLPVGAWL

SEQ ID NO: 2437 - protein, 50 aa, Homo Sapiens [sequence omitted]

SEQ ID NO: 2438 - protein, 51 aa, Homo Sapiens
  Cancerous prostate
  SIGNAL -15..-1: Von Heijne matrix; score 6.70; seq ILSTVTALTFARA/LD
MGILSTVTALTFARALDGCRNGIAHPASEKHRLEKCRELESSHSAPGSTQQ

SEQ ID NO: 2439 - protein, 34 aa, Homo Sapiens
  Normal prostate
  SIGNAL -23..-1: Von Heijne matrix
  score 6.50
  seq LTFLQXLLISSLX/RE
  UNSURE -1: Xaa = Leu,Pro,Gln
  UNSURE -8: Xaa = Leu,Val
MELGCWTQLGLTFLQXLLISSLXREYTVINEARK

SEQ ID NO: 2440 - protein, 36 aa, Homo Sapiens
  Prostate
  SIGNAL -22..-1: Von Heijne matrix
  score 6.40
  seq FLLCXSVFTDCKG/DV
  UNSURE -9: Xaa = Cys,Ser
MELLRVCSFFLLCXSVFTDCKGDVLCVKMEQSQICA

SEQ ID NO: 2441 - protein, 29 aa, Homo Sapiens [sequence omitted]

SEQ ID NO: 2442 - protein, 40 aa, Homo Sapiens
  Normal prostate
  SIGNAL -19..-1: Von Heijne matrix; score 6.30; seq MVALCCCLWKISG/CE
MQFLFKMVALCCCLWKISGCEEVPLTYNLLKCLLDKAHVG

SEQ ID NO: 2443 - protein, 66 aa, Homo Sapiens
  Cancerous prostate
  SIGNAL -21..-1: Von Heijne matrix
  score 6.30
  seq CVCAAAXXSQSLX/XX
  UNSURE -7: Xaa =  * ,Leu,Trp
  UNSURE -1: Xaa = Ala,Gly
  UNSURE 2: Xaa = Ala,Ser
  UNSURE 1: Xaa = Ala,Thr
  UNSURE 26: Xaa = Arg,Thr
  UNSURE 44: Xaa = Asp,Tyr
  UNSURE -6: Xaa = Cys,Trp
  UNSURE 36: Xaa = Lys,Gln
  UNSURE 34: Xaa = Phe,Val
MLKVSAVLCVCAAAXXSQSLXXXAAVAAAGGRSDGGNFLDDKQWLTXISQYDKEXGXWNKFRDDXY

SEQ ID NO: 2444 - protein, 57 aa, Homo Sapiens
  Hypertrophic prostate
  SIGNAL -21..-1: Von Heijne matrix; score 6.30; seq MVALCCCLWKISG/CE
MSMQFLFKMVALCCCLWKISGCEEVPLTYNLLKCLLDKAHCVLLTPCGYIFSLISPG

SEQ ID NO: 2445 - protein, 20 aa, Homo Sapiens
  Normal prostate
  SIGNAL -17..-1: Von Heijne matrix; score 6.20; seq LWILLGSLSCRTS/NR
MAQHLWILLGSLSCRTSNRR

SEQ ID NO: 2446 - protein, 59 aa, Homo Sapiens
  Normal prostate
  SIGNAL -28..-1: Von Heijne matrix
  score 6.10
  seq LYLFSGFWTFXLG/KF
  UNSURE 7: Xaa =  * ,Trp
  UNSURE 11: Xaa = Cys,Gly
  UNSURE -24: Xaa = Glu,Lys
  UNSURE 23: Xaa = Glu,Val
  UNSURE 10: Xaa = Ile,Met
  UNSURE -3: Xaa = Leu,Val
  UNSURE -18: Xaa = Lys,Arg
  UNSURE -21: Xaa = Phe,Leu
MNKEXVSXERXAQVRLYLFSGFWTFXLGKFKQGEXSYXXILERLLWQQQYXGWLVGDKR

SEQ ID NO: 2447 - protein, 80 aa, Homo Sapiens
  Normal prostate
  SIGNAL -54..-1: Von Heijne matrix
  score 6.00
  seq IVFIFLILLNTAA/QV
  UNSURE -46: Xaa = His,Gln
MVLWRAKIXRNVPVTLSEENRSEGKVGFQAYKNYFRAGAHWIVFIFLILLNTAAQVAYVLQDWWLSYWANKQSMLNVTVN

SEQ ID NO: 2448 - protein, 36 aa, Homo Sapiens
  Normal prostate
  SIGNAL -18..-1: Von Heijne matrix
  score 6.00
  seq FTSVLWLTSPSQP/NT
  UNSURE -15: Xaa =  * ,Tyr
MLLXFFTSVLWLTSPSQPNTCPSSLLCTYPNLNPPW

SEQ ID NO: 2449 - protein, 30 aa, Homo Sapiens
  Cancerous prostate
  SIGNAL -22..-1: Von Heijne matrix; score 5.90; seq IILGCLALFLLLQ/RK
MELISPTVIIILGCLALFLLLQRKNLRRPW

SEQ ID NO: 2450 - protein, 53 aa, Homo Sapiens
  Normal prostate
  SIGNAL -47..-1: Von Heijne matrix; score 5.90; seq TWLGLLSFQNLHC/FP
MHGFEIISLKEESPLGKVSQGPLFNVTSGSSSPVTWLGLLSFQNLHCFPDLPG

SEQ ID NO: 2451 - protein, 63 aa, Homo Sapiens
  Cancerous prostate
  SIGNAL -56..-1: Von Heijne matrix; score 5.90; seq NTLFLHLSGLSAA/DT
MTWVRHAPGKSLEWVATVTDGGDKTFYAASVKGRFNVSRDNSKNTLFLHLSGLSAADTGWWGI

SEQ ID NO: 2452 - protein, 28 aa, Homo Sapiens
  Prostate
  SIGNAL -14..-1: Von Heijne matrix; score 5.80; seq LTSFFSLTANCQS/AG
MLTSFFSLTANCQSAGTISFAAFSLMPG

SEQ ID NO: 2453 - protein, 23 aa, Homo Sapiens
  Cancerous prostate
  SIGNAL -18..-1: Von Heijne matrix
  score 5.80
  seq LTPLFFMXPTGFS/SP
  UNSURE -6: Xaa = Phe,Leu
MLLCLLTPLFFMXPTGFSSPSPG

SEQ ID NO: 2454 - protein, 37 aa, Homo Sapiens
  Cancerous prostate
  SIGNAL -21..-1: Von Heijne matrix; score 5.70; seq HSLFLSLLGLCPS/KT
MDDDYEAYHSLFLSLLGLCPSKTPINENAPVFDPEPV

SEQ ID NO: 2455 - protein, 32 aa, Homo Sapiens
  Hypertrophic prostate
  SIGNAL -19..-1: Von Heijne matrix; score 5.70; seq WLVWLLLGHMVVS/QM
MEWGKQWLVWLLLGHMVVSQMATLLARKHRPW

SEQ ID NO: 2456 - protein, 49 aa, Homo Sapiens
  Prostate
  SIGNAL -39..-1: Von Heijne matrix; score 5.70; seq LTQGVLWILVIQA/VP
MRRGKRLLESQSSSPKACLQLGFETELTQGVLWILVIQAVPVPSLTKTK

SEQ ID NO: 2457 - protein, 24 aa, Homo Sapiens
  Normal prostate
  SIGNAL -20..-1: Von Heijne matrix; score 5.70; seq ALLESVVWLPCHG/RG
MVAATEAALLESVVWLPCHGRGGS

SEQ ID NO: 2458 - protein, 22 aa, Homo Sapiens
  Normal prostate
  SIGNAL -19..-1: Von Heijne matrix; score 5.60; seq VSLPLLSSWGSTA/WT
MSWNPSVSLPLLSSWGSTAWTL

SEQ ID NO: 2459 - protein, 47 aa, Homo Sapiens [sequence omitted]

SEQ ID NO: 2460 - protein, 46 aa, Homo Sapiens
  Normal prostate
  SIGNAL -35..-1: Von Heijne matrix
  score 5.50
  seq LLTFGLEVCLAAG/SP
  UNSURE -17: Xaa = Gly,Leu,Val,Trp
  UNSURE -15: Xaa = Gly,Val
MVQRLWVSRLLRHRKAQLXLXNLLTFGLEVCLAAGSPMCRLCCWKW

SEQ ID NO: 2461 - protein, 122 aa, Homo Sapiens
  Cancerous prostate
  SIGNAL -18..-1: Von Heijne matrix
  score 5.50
  seq PFALVTSCSSVFS/GD
  UNSURE 68: Xaa = Cys,Phe,Gly,Ile,Ser,Val
  UNSURE 71: Xaa = Glu,Lys
MAAGVPFALVTSCSSVFSGDQLVQHILGTEDLIVEVTSNDAVRFYPWTIDNKYYSADINLCVVPNKFLVTAEIAESVQAFVVYFDXTQXSGLDSVSSWLPLAKAWLPEVMILVCDRVSEDGI

SEQ ID NO: 2462 - protein, 23 aa, Homo Sapiens
  Prostate
  SIGNAL -14..-1: Von Heijne matrix
  score 5.50
  seq TVFLXFCFPRCHS/DS
  UNSURE -9: Xaa =  * ,Ser,Tyr
  UNSURE 4: Xaa = Lys,Arg
  UNSURE 5: Xaa = Met,Val
MTVFLXFCFPRCHSDSHXXQQSA

SEQ ID NO: 2463 - protein, 89 aa, Homo Sapiens
  Hypertrophic prostate
  SIGNAL -48..-1: Von Heijne matrix
  score 5.40
  seq ILLEVFVWNGLQG/LP
  UNSURE -47: Xaa = Phe,Val
MXPNNFWQKLGRKKPRIFTCTQSSTGEAAVKAENLILLEVFVWNGLQGLPSELSDTSGSSKKLGSLVGWWRTLKMAPACLWSMWESPPR

SEQ ID NO: 2464 - protein, 73 aa, Homo Sapiens
  Cancerous prostate
  SIGNAL -36..-1: Von Heijne matrix
  score 5.30
  seq ALYIMCVPHSVWG/CA
  UNSURE -28: Xaa = Asn,Ser
MFRSDRMWXCHWKWKPSPLLFLFALYIMCVPHSVWGCANCRVVLSNPSGTFTSPCYPNDYPNSQACMWTLRDP

SEQ ID NO: 2465 - protein, 92 aa, Homo Sapiens
  Normal prostate
  SIGNAL -31..-1: Von Heijne matrix; score 5.30; seq LVALSSELPFLGA/GV
MTQRSIAGPICNLKFVTLLVALSSELPFLGAGVQLQDNGYNGLLIAINPQVPENQNLISNIKEMITEASFYLFNATKRRVFFRNIKILIPAQ

SEQ ID NO: 2466 - protein, 46 aa, Homo Sapiens
  Prostate
  SIGNAL -14..-1: Von Heijne matrix; score 5.30; seq IIPLLLLLRSACN/VH
MIIPLLLLLRSACNVHLPHQTASPASLSPQGLAWGLLHGGCSVTVR

SEQ ID NO: 2467 - protein, 21 aa, Homo Sapiens
  Hypertrophic prostate
  SIGNAL -19..-1: Von Heijne matrix
  score 5.30
  seq VLLLSXNLNLIIQ/SS
  UNSURE -18: Xaa =  * ,Ser,Tyr
  UNSURE -8: Xaa = Cys,Phe
MXSPLPVLLLSXNLNLIIQSS

SEQ ID NO: 2468 - protein, 53 aa, Homo Sapiens
  Normal prostate
  SIGNAL -46..-1: Von Heijne matrix
  score 5.20
  seq LLTFLVFTXKLSS/LN
  UNSURE -5: Xaa = Glu,Gly
  UNSURE 4: Xaa = Gly,Arg
  UNSURE -30: Xaa = Ile,Met
  UNSURE -29: Xaa = Lys,Arg
MLMCKMLKSQKNCQENXXIKIILFLKPMCSPQYLLTFLVFTXKLSSLNIXKFH

SEQ ID NO: 2469 - protein, 55 aa, Homo Sapiens
  Cancerous prostate
  SIGNAL -52..-1: Von Heijne matrix
  score 5.20
  seq IIVILHCAASIIS/CP
  UNSURE -36: Xaa =  * ,Cys,Trp,Tyr
MKKKSSPNQYLHSSLHXIRLFSFLHFSEEGVLLLAIDLKIIVILHCAASIISCPS

SEQ ID NO: 2470 - protein, 73 aa, Homo Sapiens [sequence omitted]

SEQ ID NO: 2471 - protein, 75 aa, Homo Sapiens
  Normal prostate
  SIGNAL -50..-1: Von Heijne matrix; score 5.10; seq RTALILAVCCGSA/SI
MHHGLTPLLLGVHEQKQQVVKFLIKKKANLNALDRYGRTALILAVCCGSASIVSLLLEQNIDVSSQDLSGQTAPG

SEQ ID NO: 2472 - protein, 21 aa, Homo Sapiens [sequence omitted]

SEQ ID NO: 2473 - protein, 90 aa, Homo Sapiens
  Hypertrophic prostate
  SIGNAL -31..-1: Von Heijne matrix
  score 5.10
  seq VSGASGFLPPARS/RI
  UNSURE 11: Xaa = Ala,Gly,Ile,Leu,Pro,Arg,Ser,Thr,Val
  UNSURE -20: Xaa = Arg,Ser
MAEEMESSLEAXFSSSGAVSGASGFLPPARSRIFKIIVIGDXNVGKTCLTYRFCAGRFPDRTEATIGVDFRERAVEIDGERIKIQLWDTA

SEQ ID NO: 2474 - protein, 61 aa, Homo Sapiens
  Hypertrophic prostate
  SIGNAL -31..-1: Von Heijne matrix
  score 5.10
  seq VSGASGFLPPARS/RI
  UNSURE 14: Xaa = Gly,Arg,Ser
MAEEMESSLEASFSSSGAVSGASGFLPPARSRIFKIIVIGDSNVXKTCLTYRFCAGRFPDR

SEQ ID NO: 2475 - protein, 42 aa, Homo Sapiens [sequence omitted]

SEQ ID NO: 2476 - protein, 82 aa, Homo Sapiens
  Cancerous prostate
  SIGNAL -55..-1: Von Heijne matrix; score 5.00; seq VLFMTTAVDLVIT/EV
MHLLDLESMGKSSDGKSYVITGSWNPKSPHFQVVNEETPKDKVLFMTTAVDLVITEVQEPVRFLLETKVRVCSPNERLFWPA

SEQ ID NO: 2477 - protein, 43 aa, Homo Sapiens
  Normal prostate
  SIGNAL -21..-1: Von Heijne matrix
  score 4.80
  seq VLFVFSSIPLTFL/FQ
  UNSURE 10: Xaa =  * ,Gly
MENLKDFYVLFVFSSIPLTFLFQKLPFVWIXEETLETWYLKSW

SEQ ID NO: 2478 - protein, 20 aa, Homo Sapiens [sequence omitted]

SEQ ID NO: 2479 - protein, 60 aa, Homo Sapiens
  Normal prostate
  SIGNAL -43..-1: Von Heijne matrix; score 4.80; seq LLAFGTSCSVVLY/DP
MVAPVLETSHVFCCPNRVRGVLNWSSGPRGLLAFGTSCSVVLYDPLGCCYQLEWSHRPFR

SEQ ID NO: 2480 - protein, 71 aa, Homo Sapiens
  Hypertrophic prostate
  SIGNAL -38..-1: Von Heijne matrix
  score 4.80
  seq LSWLITWFGHXLS/DF
  UNSURE -3: Xaa = Asp,Glu,Val
MPIIDQVNPELHDFMQSAEVGTIFALSWLITWFGHXLSDFRHVVRLYDFFLACHPLMPIYFAAVIVLYREQ

SEQ ID NO: 2481 - protein, 104 aa, Homo Sapiens
  Cancerous prostate
  SIGNAL -49..-1: Von Heijne matrix
  score 4.70
  seq GLCVLVPCSXSXX/WR
  UNSURE 39: Xaa =  * ,Asp,Glu,Tyr
  UNSURE -2: Xaa =  * ,Tyr
  UNSURE 38: Xaa = Ala,Asp,Glu,His,Pro,Gln
  UNSURE -1: Xaa = Ala,Pro
  UNSURE -30: Xaa = Asp,Glu
  UNSURE -35: Xaa = Asp,Glu,Gly,Val
  UNSURE -37: Xaa = Cys,Gly
  UNSURE -46,-4: Xaa = Cys,Phe
  UNSURE 42: Xaa = Gly,Trp
  UNSURE -31,41: Xaa = His,Gln
  UNSURE 40: Xaa = Ile,Thr
  UNSURE 36: Xaa = Leu,Val
METXCPCCCCPCXGXGSLXXKPVYELQVQKSVTVQEGLCVLVPCSXSXXWRSWYSSPPLYVYWFRDGEIPYYAEVVATNNPDRRXKXXXXXPIPPPWGCPEEEL

SEQ ID NO: 2482 - protein, 35 aa, Homo Sapiens
  Cancerous prostate
  SIGNAL -17..-1: Von Heijne matrix
  score 4.70
  seq IYFFACFXXLTSS/SP
  UNSURE -5: Xaa =  * ,Ala,Glu,Gly,Ile,Lys,Leu,Pro,Gln,Arg,Ser,Thr,Val
  UNSURE -6: Xaa = His,Gln
MSPCIYFFACFXXLTSSSPPHPCPKCWPSSGSIPL

SEQ ID NO: 2483 - protein, 33 aa, Homo Sapiens
  Normal prostate
  SIGNAL -27..-1: Von Heijne matrix
  score 4.70
  seq VLKCLSFSXPSLP/GF
  UNSURE -5: Xaa = Ala,Pro
MGRGERRHYWGPKLVLKCLSFSXPSLPGFLWSL

SEQ ID NO: 2484 - protein, 81 aa, Homo Sapiens
  Cancerous prostate
  SIGNAL -52..-1: Von Heijne matrix
  score 4.70
  seq LLAKALHLLKSSC/AP
  UNSURE -46: Xaa = Leu,Val
MSQDGGXGELKHMVMSFRVSELQVLLGFAGRNKSGRKHELLAKALHLLKSSCAPSVQMKIKELYRRRFPRKTLGPSDLSLK

SEQ ID NO: 2485 - protein, 85 aa, Homo Sapiens
  Normal prostate
  SIGNAL -69..-1: Von Heijne matrix
  score 4.60
  seq LGPSLSSLPSALS/LM
  UNSURE 7: Xaa = Phe,Ile,Val
MHHRMNEMNLSPVGMEQLTSSSVSNALPVSGSHLGLAASPTHSAIPAPGLPVAIPNLGPSLSSLPSALSLMLPMGXGDRGVMCGL

SEQ ID NO: 2486 - protein, 22 aa, Homo Sapiens [sequence omitted]

SEQ ID NO: 2487 - protein, 44 aa, Homo Sapiens
  Normal prostate
  SIGNAL -24..-1: Von Heijne matrix; score 4.60; seq FHSAAGWSGGGQA/CG
MQPASPPARWSFHSAAGWSGGGQACGGHSCDQVLAVIELLNPLR

SEQ ID NO: 2488 - protein, 32 aa, Homo Sapiens
  Cancerous prostate
  SIGNAL -18..-1: Von Heijne matrix; score 4.50; seq LLAGSISHMFSQA/LP
MCFSFLLAGSISHMFSQALPLHSPGLPTTNRT

SEQ ID NO: 2489 - protein, 26 aa, Homo Sapiens [sequence omitted]

SEQ ID NO: 2490 - protein, 31 aa, Homo Sapiens
  Normal prostate
  SIGNAL -24..-1: Von Heijne matrix
  score 4.50
  seq SLLGCXLAININT/FP
  UNSURE -20: Xaa = Cys,Gly
  UNSURE -8: Xaa = His,Leu,Pro,Arg
MSFGXILTFRVSLLGCXLAININTFPSNNHL

SEQ ID NO: 2491 - protein, 86 aa, Homo Sapiens
  Prostate
  SIGNAL -22..-1: Von Heijne matrix
  score 4.40
  seq LGRLCAGSSGVXG/AR
  UNSURE 4: Xaa = Ala,Gly
  UNSURE -2: Xaa = Leu,Val
MAVYVGMLRLGRLCAGSSGVXGARAXLSRSWQEARLQGVRFLSSREVDRMVSTPIGGLSYVQGCTKKHLNSKTVGQCLETTAQRVP

SEQ ID NO: 2492 - protein, 30 aa, Homo Sapiens [sequence omitted]

SEQ ID NO: 2493 - protein, 34 aa, Homo Sapiens [sequence omitted]

SEQ ID NO: 2494 - protein, 28 aa, Homo Sapiens [sequence omitted]

SEQ ID NO: 2495 - protein, 51 aa, Homo Sapiens
  Normal prostate
  SIGNAL -28..-1: Von Heijne matrix
  score 4.30
  seq LLSCSPLXPLGKS/GF
  UNSURE -6: Xaa =  * ,Cys
  UNSURE 20: Xaa = Ala,Pro,Ser,Thr
  UNSURE -16: Xaa = Asn,Ser
  UNSURE -27: Xaa = Ile,Lys
  UNSURE 18: Xaa = Ile,Met
MXMKSANKITLLXHHLLSCSPLXPLGKSGFSSCQRLGKRALVFPIXKXIIT

SEQ ID NO: 2496 - protein, 34 aa, Homo Sapiens
  Cancerous prostate
  SIGNAL -32..-1: Von Heijne matrix; score 4.20; seq SFLLLFIVIPQTP/RP
MCNYNIYVLYNIGYLYHPKSFLLLFIVIPQTPRP

SEQ ID NO: 2497 - protein, 100 aa, Homo Sapiens
  Normal prostate
  SIGNAL -27..-1: Von Heijne matrix
  score 4.20
  seq PLLAAPLLRSLLP/RX
  UNSURE 2: Xaa = Ala,Glu
  UNSURE 53: Xaa = Cys,Gly,Ser
  UNSURE 34: Xaa = Gly,Arg
  UNSURE 43: Xaa = Gly,Ser
  UNSURE 64: Xaa = Leu,Met
  UNSURE 45: Xaa = Lys,Arg
MAVAMVKLCERAGLPLLAAPLLRSLLPRXPQPGPAQPRSVQGQRCPARHPPGNLVCERGAXVNGVTAGAXGXLRGLHRGXRALGCSAHRPXHSARVRPPA

SEQ ID NO: 2498 - protein, 127 aa, Homo Sapiens
  Cancerous prostate
  SIGNAL -122..-1: Von Heijne matrix
  score 4.20
  seq DVLLGLLKDVLLA/RP
  UNSURE -113: Xaa = Phe,Val
MLNVVRALRXPQWCAEYCLSIHYQHGGVICTQVHKQTVVQLALRVADEMDVNIGHEVGYVIPFENCCTNETILRYCTDDMLQREMMSNPFLGSYGVIILDDIHERSIATDVLLGLLKDVLLARPELK

SEQ ID NO: 2499 - protein, 34 aa, Homo Sapiens
  Normal prostate
  SIGNAL -27..-1: Von Heijne matrix
  score 4.20
  seq AGLCIGSTSYVHG/DI
  UNSURE -20: Xaa = Asp,Glu,Lys,Asn
  UNSURE -18: Xaa = Ile,Asn
MHAGLERXSXQKALAGLCIGSTSYVHGDILRTER

SEQ ID NO: 2500 - protein, 45 aa, Homo Sapiens
  Prostate
  SIGNAL -35..-1: Von Heijne matrix; score 4.20; seq LLGSLSLWRWSAM/EP
MLNGPFQHRNSRIMTHRSAEKTLLGSLSLWRWSAMEPTDRCTRVG

SEQ ID NO: 2501 - protein, 122 aa, Homo Sapiens
  Cancerous prostate
  SIGNAL -44..-1: Von Heijne matrix; score 4.10; seq IAVGLTCQHVSHA/IS
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPHCIIINLST

SEQ ID NO: 2502 - protein, 32 aa, Homo Sapiens [sequence omitted]

SEQ ID NO: 2503 - protein, 86 aa, Homo Sapiens
  Normal prostate
  SIGNAL -55..-1: Von Heijne matrix
  score 4.00
  seq AALCGISLSQLFP/EP
  UNSURE -47: Xaa =  * ,Glu,Gln
  UNSURE -22: Xaa = Ala,Leu,Pro,Ser,Val
  UNSURE -23: Xaa = Asp,Glu
  UNSURE -48: Xaa = Cys,Trp
  UNSURE 17: Xaa = Gly,Leu,Arg,Val
  UNSURE -39: Xaa = Leu,Val
  UNSURE -46: Xaa = Lys,Met,Arg,Thr
MAMWNRPXXXLPQQPLXAEPTAEGEPHLPTGRXXTEANRFAYAALCGISLSQLFPEPEHSSFCTEFMAGLVXWLELSEAVLPTMTA

SEQ ID NO: 2504 - protein, 23 aa, Homo Sapiens
  Normal prostate
  SIGNAL -19..-1: Von Heijne matrix; score 4.00; seq LLLSPWVTVPVWS/SS
MLCFGDLLLSPWVTVPVWSSSPW

SEQ ID NO: 2505 - protein, 48 aa, Homo Sapiens
  Normal prostate
  SIGNAL -27..-1: Von Heijne matrix
  score 4.00
  seq LIYFLGLAADTYF/RS
  UNSURE 17: Xaa = Asn,Thr
  UNSURE 14: Xaa = Gly,Leu,Val,Trp
  UNSURE 15: Xaa = Pro,Gln
MQENAHNLRLFKCLLIYFLGLAADTYFRSKRKPVSFVVTVXXGXYATG

SEQ ID NO: 2506 - protein, 63 aa, Homo Sapiens
  Normal prostate
  SIGNAL -59..-1: Von Heijne matrix; score 4.00; seq SVATALFPPLCIS/TG
MHTCSLPCLLFAQLLEFCSFPPDVPHNCAPIVSVRPPNIVAAFEGCSVATALFPPLCISTGNE

SEQ ID NO: 2507 - protein, 96 aa, Homo Sapiens
  Hypertrophic prostate
  SIGNAL -28..-1: Von Heijne matrix
  score 4.00
  seq PLLGVLFFQGVYI/VF
  UNSURE 54: Xaa = Phe,Leu,Val
MQQRGAAGSRGCALFPLLGVLFFQGVYIVFSLEIRADAHVRGYVGEKIKLKCTFKSTSDVTDKLTIDWTYRPPSSSHTVSIXHYQSFQYPTTAGTF

SEQ ID NO: 2508 - protein, 107 aa, Homo Sapiens
  Cancerous prostate
  SIGNAL -39..-1: Von Heijne matrix
  score 3.90
  seq LILNRSLPTASSS/SS
  UNSURE 58: Xaa =  * ,Gly,Arg
  UNSURE 49: Xaa = Arg,Ser
  UNSURE -37: Xaa = Asp,Glu
  UNSURE 53: Xaa = Gly,Ser
  UNSURE -38: Xaa = His,Gln
  UNSURE 51: Xaa = Ile,Thr
  UNSURE 52: Xaa = Lys,Asn
  UNSURE 43: Xaa = Phe,Leu
MXXSIFISEKYGLCPSKTPIMKMLPSLILNRSLPTASSSSSRKDFRLPQTRRRIIMVPRKEDQTPLNPASQPQAPPKPIPSXKSLEAXDXXXSQRTXRPGLSRGRSC

SEQ ID NO: 2509 - protein, 75 aa, Homo Sapiens
  Hypertrophic prostate
  SIGNAL -20..-1: Von Heijne matrix; score 3.90; seq FFWVVLFSAGCKV/IT
MAFDVSCFFWVVLFSAGCKVITSWDQMYIEKEANKTYNCENLGLSEIPDTLPNTTEFLEFSFNFLPTIHNRTSSR

SEQ ID NO: 2510 - protein, 105 aa, Homo Sapiens
  Normal prostate
  SIGNAL -96..-1: Von Heijne matrix
  score 3.90
  seq IMNLTVMLDTAXG/KX
  UNSURE -54: Xaa =  * ,Glu
  UNSURE -2: Xaa = Phe,Leu
  UNSURE -72: Xaa = Phe,Leu,Val
  UNSURE 2: Xaa = Pro,Thr
MEVAANCSLRVKRPLLDPRFEGYKXSLEPLPCYQLELDAAVAXVKLRDDQYTLEHMHAFGMYNYLHCDSWYQDSVYYIDTLGRIMNLTVMLDTAXGKXREVFRLL

SEQ ID NO: 2511 - protein, 95 aa, Homo Sapiens
  Normal prostate
  SIGNAL -39..-1: Von Heijne matrix
  score 3.90
  seq VLAIGLLHIVLLS/IP
  UNSURE -31: Xaa =  * ,Glu,Lys
  UNSURE 48: Xaa =  * ,Leu
  UNSURE -32: Xaa = Arg,Ser
  UNSURE 47: Xaa = Cys,Trp
  UNSURE 31,45: Xaa = Ser,Thr
MNVGTAHXXVNPNTRVMNSRGIWLSYVLAIGLLHIVLLSIPFVSVPVVWTLTNLIHNMGMYIFLHTVKGXPFETPDQGKARLLXHXXADGLWGPV

SEQ ID NO: 2512 - protein, 48 aa, Homo Sapiens [sequence omitted]

SEQ ID NO: 2513 - protein, 70 aa, Homo Sapiens
  Normal prostate
  SIGNAL -39..-1: Von Heijne matrix
  score 3.90
  seq VLAIGLLHIVLLS/IP
  UNSURE -34: Xaa = Ala,Asp,Glu,Gly,Val
MNVGTXHSEVNPNTRVMNSRGIWLSYVLAIGLLHIVLLSIPFVSVPVVWTLTNLIHNMGMYIFLYTVKGT

SEQ ID NO: 2514 - protein, 49 aa, Homo Sapiens
  Prostate
  SIGNAL -14..-1: Von Heijne matrix; score 3.80; seq AAASAVSVLLVAA/ER
MAAASAVSVLLVAAERNRWHRLPSLLLPPRTWVWRQRTMKYTTATGRNM

SEQ ID NO: 2515 - protein, 95 aa, Homo Sapiens
  Cancerous prostate
  SIGNAL -44..-1: Von Heijne matrix; score 3.80; seq SGSGLSWARLSQS/RS
MAYSKASGSPVLSQAVPGENASHRRGSADLGSGSGLSWARLSQSRSEIHSAGPPHLGGRTNGPEFPALSYSSQLLSLAQLRGRGITEVSEKSPLI

SEQ ID NO: 2516 - protein, 95 aa, Homo Sapiens
  Normal prostate
  SIGNAL -37..-1: Von Heijne matrix; score 3.80; seq RPVLLHLHQTAHA/DE
MKPRRNLEEDDYLHKDTGETSMLKRPVLLHLHQTAHADEFDCPSELQHTQELFPQWHLPIKIAAIIASLTFLYTLLREVIHPLATSHQQYFYKIQ

SEQ ID NO: 2517 - protein, 39 aa, Homo Sapiens [sequence omitted]

SEQ ID NO: 2518 - protein, 70 aa, Homo Sapiens
  Cancerous prostate
  SIGNAL -19..-1: Von Heijne matrix; score 3.70; seq STLASVPPAATFG/AD
MYSSEDSTLASVPPAATFGADDLVLTLSNPQMSLEGTEKASWLGEQPQFWSKTQVLDWISYQVEKNKYDA

SEQ ID NO: 2519 - protein, 70 aa, Homo Sapiens
  Normal prostate
  SIGNAL -65..-1: Von Heijne matrix
  score 3.70
  seq QLEGLNWLRFSWA/QG
  UNSURE -52: Xaa =  * ,Lys,Leu,Met
  UNSURE -60: Xaa = Ala,Ser
  UNSURE 4: Xaa = Asp,Phe,Val,Tyr
  UNSURE -44: Xaa = Gly,Trp
  UNSURE -50: Xaa = Lys,Met
MGEDPXQPRKYKKXKXELQGDXPPSSPTNDPTVKYETQPRFITATGGTLHMYQLEGLNWLRFSWAQGTXG

SEQ ID NO: 2520 - protein, 75 aa, Homo Sapiens
  Prostate
  SIGNAL -42..-1: Von Heijne matrix
  score 3.70
  seq LLGCLQCCWLQSG/RA
  UNSURE 22: Xaa = Cys,Gly,Arg,Ser
MFYVAMTKTHKRIRSLCNIHHGLFQFTQQLLGCLQCCWLQSGRAPATYYLVESIEKSAHGSVLXTYDQTQTRIGR

SEQ ID NO: 2521 - protein, 62 aa, Homo Sapiens
  Hypertrophic prostate
  SIGNAL -60..-1: Von Heijne matrix
  score 3.70
  seq XTCASXNPSQCLA/AF
  UNSURE -8: Xaa = Ala,Thr
  UNSURE -13: Xaa = Leu,Met,Pro,Ser,Thr
MVSPKDLPLVLLQDIKVPSSMTGSHAGNPHIERNDLPRHGSPQFFTGXTCASXNPSQCLAAF

SEQ ID NO: 2522 - protein, 26 aa, Homo Sapiens
  Prostate
  SIGNAL -15..-1: Von Heijne matrix
  score 3.60
  seq FXSLFCLYFSCFL/HI
  UNSURE 6: Xaa = Cys,Phe,Gly,Val
  UNSURE -12: Xaa = Phe,Val
MEFXSLFCLYFSCFLHIIYFXSCFLY

SEQ ID NO: 2523 - protein, 66 aa, Homo Sapiens
  Cancerous prostate
  SIGNAL -45..-1: Von Heijne matrix
  score 3.60
  seq ALLELIDSPECLS/KC
  UNSURE 21: Xaa = Gly,Val
  UNSURE -33: Xaa = Met,Val
MALHFQSLAELEXLCTHLYIGTDLTQRIEAEKALLELIDSPECLSKCQLLLEQGTTSYAQLLAATX

SEQ ID NO: 2524 - protein, 40 aa, Homo Sapiens
  Normal prostate
  SIGNAL -27..-1: Von Heijne matrix; score 3.60; seq LTLLLITPSPSPL/LF
MRTLFGAVRAPFSSLTLLLITPSPSPLLFDRGLSLRSAMS

SEQ ID NO: 2525 - protein, 44 aa, Homo Sapiens
  Cancerous prostate
  SIGNAL -41..-1: Von Heijne matrix; score 3.60; seq AVSSLIAVGTSHG/LA
MRHSLLKGISAQIVSAADKVDAGLPTAIAVSSLIAVGTSHGLAG

SEQ ID NO: 2526 - protein, 23 aa, Homo Sapiens
  Normal prostate
  SIGNAL -15..-1: Von Heijne matrix; score 3.50; seq LSCFIFFYISSLC/CF
MTLSCFIFFYISSLCCFLSYPTR

SEQ ID NO: 2527 - protein, 47 aa, Homo Sapiens
  Normal prostate
  SIGNAL -15..-1: Von Heijne matrix; score 3.50; seq LCFLLPHHRLQEA/RQ
MILCFLLPHHRLQEARQIQVLKMLPREKLRRRRREKTNKWEKRKGSG

SEQ ID NO: 2528 - protein, 24 aa, Homo Sapiens [sequence omitted]

SEQ ID NO: 2529 - protein, 47 aa, Homo Sapiens
  Cancerous prostate
  SIGNAL -31..-1: Von Heijne matrix; score 3.50; seq SVWGVLPPPACSA/DL
MASSPGVAMHSLWATIHTSVWGVLPPPACSADLLFSNACLLPHEIHL

SEQ ID NO: 2530 - protein, 86 aa, Homo Sapiens
  Prostate
  SIGNAL -45..-1: Von Heijne matrix; score 3.50; seq LPRLLSLSQHSES/WI
MSQEGAVPASAVPLEELSSWPEELCRRELPSVLPRLLSLSQHSESWIEHIQILKIIVEMFLPHMNHLTLEQTFFSQVLPKTVKLFD

SEQ ID NO: 2531 - protein, 39 aa, Homo Sapiens
  Cancerous prostate
  SIGNAL -36..-1: Von Heijne matrix; score 3.50; seq AAVVFAVVLSIHA/TV
MTRECPSPAPGPGAPLSGSVLAEAAVVFAVVLSIHATVW

SEQ ID NO: 2532 - protein, 85 aa, Homo Sapiens
  Normal prostate
  SIGNAL -18..-1: Von Heijne matrix; score 14.80; seq LLWWALLLGLAQA/CP
MQELHLLWWALLLGLAQACPEPCDCGEKYGFQIADCAYRDLESVPPGFPANVTTLSLSANRLPGLPEGAFREVPLLQSLWLAHNE

SEQ ID NO: 2533 - protein, 106 aa, Homo Sapiens
  Normal prostate
  SIGNAL -18..-1: Von Heijne matrix
  score 13.60
  seq LLLLALCATGAQG/LY
  UNSURE 78: Xaa = Ala,Gly,Ser,Trp
  UNSURE 77: Xaa = Ile,Met,Arg,Ser,Thr
MGRQALLLLALCATGAQGLYFHIGETEKRCFIEEIPDETMVIGNYRTQMWDKQKEVFLPSTPGLGMHVEVKDPDGKVVLSRQYGSEGRFTFTSHXXGDHQICLHCG

SEQ ID NO: 2534 - protein, 40 aa, Homo Sapiens
  Normal prostate
  SIGNAL -21..-1: Von Heijne matrix; score 12.70; seq ILFLLSWSGPLQG/QQ
MGPSTPLLILFLLSWSGPLQGQQHHLVEYMERRLAALEER

SEQ ID NO: 2535 - protein, 78 aa, Homo Sapiens
  Prostate
  SIGNAL -27..-1: Von Heijne matrix
  score 8.80
  seq LLLLCPLSRGCCP/LL
  UNSURE 8: Xaa =  * ,Leu
  UNSURE 48: Xaa = Ala,Asp
  UNSURE 5: Xaa = Cys,Gly
  UNSURE 35: Xaa = His,Gln
MSCRELTHRPCSPHLLLLCPLSRGCCPLLLSXPLXGVNLESILSLTLPPSPSSVGLSPSVTXLTTSPVSLHFASXLAG

SEQ ID NO: 2536 - protein, 121 aa, Homo Sapiens
  Normal prostate
  SIGNAL -22..-1: Von Heijne matrix
  score 8.50
  seq AALLLGLMMVVTG/DE
  UNSURE 43: Xaa = Asp,Asn,Tyr
MGWTMRLVTAALLLGLMMVVTGDEDENSPCAHEALLDEDTLFCQGLEVFYPELGNIGCKVVPDCXNYRQKITSWMEPIVKFPGAVDGATYILVMVDPDAPSRAEPRQRFWRHWLVTDIKGA

SEQ ID NO: 2537 - protein, 33 aa, Homo Sapiens
  Normal prostate
  SIGNAL -24..-1: Von Heijne matrix; score 7.30; seq VHLLSLCSGKVYA/RM
MKFLIFAFFGGVHLLSLCSGKVYARMASLRGLG

SEQ ID NO: 2538 - protein, 89 aa, Homo Sapiens
  Cancerous prostate
  SIGNAL -29..-1: Von Heijne matrix; score 7.10; seq LIFLCGAALLAVG/IW
MQCFSFIKTMMILFNLLIFLCGAALLAVGIWVSIDGASFLKIFGPLSSSAMQFVNVGYFLIAAGVVVFALGFLGCYGAKTESKCALVTF

SEQ ID NO: 2539 - protein, 51 aa, Homo Sapiens
  Cancerous prostate
  SIGNAL -28..-1: Von Heijne matrix; score 6.60; seq IVSLLGFVATVTL/IP
MWAFSELPMPLLINLIVSLLGFVATVTLIPAFRGHFIAARLCGQDLNKTSQ

SEQ ID NO: 2540 - protein, 85 aa, Homo Sapiens
  Normal prostate
  SIGNAL -19..-1: Von Heijne matrix
  score 6.30
  seq VLMRLVASAYSIA/QK
  UNSURE 61: Xaa = Ala,Glu,Lys,Thr
  UNSURE 38: Xaa = Arg,Ser
  UNSURE 21: Xaa = Lys,Met,Arg
MASSNTVLMRLVASAYSIAQKAGMIVRRVIAEGDLGIVEXTCATDLQTKADRLAQMXICSSLARKFPKLTIIGEEDLPSXEVDQE

SEQ ID NO: 2541 - protein, 71 aa, Homo Sapiens
  Normal prostate
  SIGNAL -24..-1: Von Heijne matrix
  score 5.90
  seq VHLLSLCSGKAIC/KN
  UNSURE 41: Xaa = Ala,Glu
MKFLIFAFFGGVHLLSLCSGKAICKNGISKRTFEEIKEEIASCGDVAKAIINLAVYGKAQNRSYXRLALLV

SEQ ID NO: 2542 - protein, 118 aa, Homo Sapiens
  Normal prostate
  SIGNAL -51..-1: Von Heijne matrix
  score 5.90
  seq ALXVLPLLGLHEA/AS
  UNSURE -11: Xaa = Ala,Cys,Asp,Phe,Gly,His,Ile,Leu,Asn,Pro,Arg,Ser,Thr,Val,Tyr
MADTTPNGPQGAGAVQFMMTNKLDTAMWLSRLFTVYCSALXVLPLLGLHEAASFYQRALLANALTSALRLHQRLPHFQLSRAFLAQALLEDSCHYLLYSLIFVNSYPVTMSIFPVLLF

SEQ ID NO: 2543 - protein, 73 aa, Homo Sapiens
  Cancerous prostate
  SIGNAL -24..-1: Von Heijne matrix
  score 5.50
  seq XVLVLSVVXXAMA/AF
  UNSURE -18: Xaa =  * ,Cys
  UNSURE -16: Xaa =  * ,Leu
  UNSURE -4,40: Xaa = Ala,Asp
  UNSURE 5: Xaa = Ala,Glu,Leu,Pro,Gln,Val
  UNSURE 12: Xaa = Ala,Gly,Pro,Arg
  UNSURE -5: Xaa = Ala,Pro
  UNSURE 16,17: Xaa = Leu,Met
  UNSURE 18: Xaa = Leu,Pro
  UNSURE -13: Xaa = Lys,Gln
MRFRHFXKXIGXVLVLSVVXXAMAAFAVXPQGPALXSEPXXXGSPTSPKPGVNAQFLPGFLMGXLPAPVTPQP

SEQ ID NO: 2544 - protein, 161 aa, Homo Sapiens
  Normal prostate
  SIGNAL -40..-1: Von Heijne matrix; score 5.20; seq LCVEFASVASCDA/AV
MELGSCLEGGREAAEEEGEPEVKKRRLLCVEFASVASCDAAVAQCFLAENDWEMERALNSYFEPPVEESALERRPETISEPKTYVDLTNEETTDSTTSKISPSEDTQQENGSMFSLITWNIDGLDLNNLSERARGVCSYLALYSPDVIFLQEVIPPYYSYL

SEQ ID NO: 2545 - protein, 144 aa, Homo Sapiens
  Hypertrophic prostate
  SIGNAL -122..-1: Von Heijne matrix
  score 5.00
  seq RLVVVSVSPQSRA/SL
  UNSURE -51: Xaa =  * ,Glu,Lys,Leu,Met,Gln,Val
  UNSURE -66: Xaa = Gly,Arg,Trp
  UNSURE 9: Xaa = Lys,Asn
MASPFSGALQLTDLDDFIGPSQECIKPVKVEKRAGSGVAKIRIEDDGSYFQINQDGXTRRLEKAKVSLNYCXACSGCITSAETVLITQQSHEELKKVLDANKMAAPSQQRLVVVSVSPQSRASLAARFQLXPTDTARKLTSFFK

SEQ ID NO: 2546 - protein, 84 aa, Homo Sapiens
  Prostate
  SIGNAL -44..-1: Von Heijne matrix; score 4.80; seq SLVAELLLGAGSG/SH
MGPVPTAVAGAGSRLVKPSQTLSLTCAVSGGSLVAELLLGAGSGSHLGRAWSGLGSSIIEAIVGVLLTIRPSRLEPPYHWTSPA

SEQ ID NO: 2547 - protein, 88 aa, Homo Sapiens
  Normal prostate
  SIGNAL -23..-1: Von Heijne matrix
  score 4.40
  seq QFILLGTTSVVTA/AL
  UNSURE 35: Xaa = Ala,Gly
MESGGRPSLCQFILLGTTSVVTAALYSVYRQKARVSQELKGAKKVHLGEDLKSILSEXPGKCVPYAVIEGAVRSVKETLNSQFVENCK

SEQ ID NO: 2548 - protein, 21 aa, Homo Sapiens
  Cancerous prostate
  SIGNAL -19..-1: Von Heijne matrix
  score 4.10
  seq IYIICFXLPPLFS/FN
  UNSURE -7: Xaa = Phe,Tyr
MQVCRCIYIICFXLPPLFSFN

SEQ ID NO: 2549 - protein, 50 aa, Homo Sapiens
  Normal prostate
  SIGNAL -15..-1: Von Heijne matrix; score 4.10; seq QRLLLRFLASVIS/RK
MAQRLLLRFLASVISRKPSQGQWATPHFQSPADPTMQSWWPDCNTQPSPD

SEQ ID NO: 2550 - protein, 46 aa, Homo Sapiens
  Cancerous prostate
  SIGNAL -40..-1: Von Heijne matrix
  score 3.90
  seq FLWLITRPQPVLP/LL
  UNSURE 6: Xaa = Leu,Arg
MLFIFNFLFSPLPTPALICILTFGAAIFLWLITRPQPVLPLLDLNX

SEQ ID NO: 2551 - protein, 49 aa, Homo Sapiens
  Hypertrophic prostate
  SIGNAL -46..-1: Von Heijne matrix; score 3.90; seq SHMLQLLPSKALC/LF
MYPKWEAPVTFCQLKREKDPPHPAHSPFLQPRFSHMLQLLPSKALCLFF

SEQ ID NO: 2552 - protein, 60 aa, Homo Sapiens
  Cancerous prostate
  SIGNAL -44..-1: Von Heijne matrix; score 3.70; seq LAERLGLFEELWA/AQ
MALYQRWRCLRLQGLQACRLHTAVVSTPPRWLAERLGLFEELWAAQVKRLASMAQKEPQT

SEQ ID NO: 2553 - protein, 61 aa, Homo Sapiens
  Normal prostate
  SIGNAL -23..-1: Von Heijne matrix
  score 13.80
  seq XGLLLFLLPGSLG/AE
  UNSURE 38: Xaa = His,Gln
  UNSURE -13: Xaa = Leu,Val
MGVPRPQPWAXGLLLFLLPGSLGAESHLSLLYHLTAVSSPAPGTPAFWVSGWLGPQQYPSX

SEQ ID NO: 2554 - protein, 109 aa, Homo Sapiens
  Cancerous prostate
  SIGNAL -45..-1: Von Heijne matrix
  score 13.40
  seq LVLALXLVSAALS/SV
  UNSURE 51: Xaa = Ala,Glu,Gly,Ile,Lys,Leu,Pro,Gln,Arg,Thr,Val
  UNSURE 47: Xaa = Ala,Pro,Ser,Thr
  UNSURE 46: Xaa = Ile,Met,Thr
  UNSURE -8: Xaa = Leu,Met,Val
  UNSURE 56: Xaa = Phe,Ser
MAAAVPKRMRGPAQAKLLPGSAIQALVGLARPLVLALXLVSAALSSVVSRTDSPSPTVLNSHISTPNVNALTHENQTKPSISQISTTLPPXXSTKXSGGAXVVPHPSPG

SEQ ID NO: 2555 - protein, 66 aa, Homo Sapiens
  Cancerous prostate
  SIGNAL -29..-1: Von Heijne matrix
  score 13.00
  seq LLLVLLLVTRXRS/MP
  UNSURE 18: Xaa = Leu,Val
  UNSURE -3: Xaa = Ser,Thr
MWLWEDQGGLLGPFSFLLLVLLLVTRXRSMPASSPAASSFYCASSAXSRCPLAGPCRCSSPGTAFL

SEQ ID NO: 2556 - protein, 82 aa, Homo Sapiens
  Normal prostate
  SIGNAL -28..-1: Von Heijne matrix; score 11.60; seq LLLLVQLLRFLRA/DG
MNWELLLWLLVLCALLLLLVQLLRFLRADGDLTLLWAEWQGRRPEWELTDMVVWVTGASSGIGEELAYQLSKLGVSLVLSAR

SEQ ID NO: 2557 - protein, 56 aa, Homo Sapiens
  Normal prostate
  SIGNAL -20..-1: Von Heijne matrix; score 11.20; seq AFLLLVALSYTLA/RD
MEKIPVSAFLLLVALSYTLARDTTVKPGAKKDTKDSRPKLPQTLSRGWGDQLIWTR

SEQ ID NO: 2558 - protein, 62 aa, Homo Sapiens
  Cancerous prostate
  SIGNAL -40..-1: Von Heijne matrix; score 11.20; seq AFLLLVALSYTLA/RD
MSNYTDAESSFSKQEIIRVAMEKIPVSAFLLLVALSYTLARDTTVKPGAKKDTKDSRPKPPR

SEQ ID NO: 2559 - protein, 108 aa, Homo Sapiens
  Cancerous prostate
  SIGNAL -53..-1: Von Heijne matrix
  score 10.60
  seq FILLLIFIAEVAA/AV
  UNSURE -50: Xaa = Ala,Glu,Gly,Val
  UNSURE 11: Xaa = Ala,Pro,Ser
  UNSURE 8: Xaa = Ile,Asn,Ser,Thr
  UNSURE 37: Xaa = Leu,Trp
MQFXTWATSSSQPALWSLLLVSWAAMVLRLRSKCALVTFFFILLLIFIAEVAAAVVALVYXTMXEHFLTLLVVPAIKKDYGSQEDFTQVXNTTMKGLKCCGFTNYTDW

SEQ ID NO: 2560 - protein, 111 aa, Homo Sapiens
  Hypertrophic prostate
  SIGNAL -28..-1: Von Heijne matrix
  score 10.50
  seq LLLLVHLLRFLRA/DG
  UNSURE 73: Xaa = Lys,Arg
  UNSURE 47: Xaa = Phe,Val
MNWELLLWLLVLCALLLLLVHLLRFLRADGDLTLLWAEWQGRRPEWELTDMVVWVTGASSGIGEELAYQLSKLGXSLVLSARRVHELERVKRRCLENGNLXEKDILVLPLG

SEQ ID NO: 2561 - protein, 76 aa, Homo Sapiens
  Normal prostate
  SIGNAL -51..-1: Von Heijne matrix; score 10.30; seq VSCLTLWSPGCWP/QP
MTTFLPVPQMMAGFSFGTFGNPPMESPSAWQTIHQPFIVSCLTLWSPGCWPQPIQRKEWDSGTFENLRVLSCAMVE

SEQ ID NO: 2562 - protein, 129 aa, Homo Sapiens
  Cancerous prostate
  SIGNAL -28..-1: Von Heijne matrix
  score 9.50
  seq LVXFSLLATAILG/AV
  UNSURE -11: Xaa = Phe,Ser
MASKGMRHFCLISEQLVXFSLLATAILGAVSWQPTNGIFLSMFLIVLPLESMAHGLFHELGNCLGGTSVGYAIVIPTNFCSPDGQPTLLPPEHVQELNLRSTGMLNAIQRFFAYHMIETYGCDYSTSGL

SEQ ID NO: 2563 - protein, 73 aa, Homo Sapiens
  Hypertrophic prostate
  SIGNAL -21..-1: Von Heijne matrix
  score 9.30
  seq VLPVILLLLGAHP/SP
  UNSURE 23: Xaa = Gly,Ile,Ser,Val
MAAAAWLQVLPVILLLLGAHPSPLSFFSAGPATVAAADRSKWHXPIPSGKNYFSFGKILFRNTTIFLKFDGER

SEQ ID NO: 2564 - protein, 113 aa, Homo Sapiens
  Cancerous prostate
  SIGNAL -109..-1: Von Heijne matrix
  score 9.10
  seq LVLAVLFFHQLVG/DP
  UNSURE -66: Xaa = Asp,His,Asn,Tyr
MASPRTVTIVALSVALGLFFVFMGTIKLTPRLSKDAYSEMKRAXKSYVRALPLLKKMGINSILLRKSIGALEVACGIVMTLVPGRPKDVANFFLLLLVLAVLFFHQLVGDPLK

SEQ ID NO: 2565 - protein, 45 aa, Homo Sapiens [sequence omitted]

SEQ ID NO: 2566 - protein, 71 aa, Homo Sapiens
  Normal prostate
  SIGNAL -55..-1: Von Heijne matrix
  score 8.80
  seq XXLLLLNVGQLLA/QT
  UNSURE -12: Xaa =  * ,Cys,Phe,Leu,Trp,Tyr
  UNSURE -13: Xaa = Gly,Arg,Trp
MGPPMLQEISNLFLILLMMGAIFTLAALKESLSTCIPAIVCLXXLLLLNVGQLLAQTKKVVRPTRKKTLST

SEQ ID NO: 2567 - protein, 74 aa, Homo Sapiens
  Cancerous prostate
  SIGNAL -71..-1: Von Heijne matrix
  score 8.60
  seq VVXFLLLLAXLIA/TY
  UNSURE -15: Xaa = Arg,Ser
  UNSURE -70: Xaa = Asp,Glu,Ile,Lys,Met,Asn,Val
  UNSURE -4: Xaa = Gly,Arg,Trp
  UNSURE -16: Xaa = His,Gln
  UNSURE -11: Xaa = Ser,Thr
  UNSURE -69: Xaa = any one of the twenty amino acids
MXXFTDPSSVNEKKRREREERQNIVLWRQPLITLQYFSLEILVILKEWTSKLWHRXXIVVXFLLLLAXLIATYY

SEQ ID NO: 2568 - protein, 21 aa, Homo Sapiens
  Normal prostate
  SIGNAL -15..-1: Von Heijne matrix
  score 8.60
  seq LLRGLLWXQVLCA/GP
  UNSURE -6: Xaa = Leu,Val
MPLLRGLLWXQVLCAGPLHTE

SEQ ID NO: 2569 - protein, 65 aa, Homo Sapiens
  Cancerous prostate
  SIGNAL -20..-1: Von Heijne matrix
  score 8.40
  seq AVVGCLLVPPAEA/NK
  UNSURE 8: Xaa = Gln,Arg
MKLLSLVAVVGCLLVPPAEANKSSEDIXCKCICPPYRNISGHIYNQNVSQKDCNCLHVVEPMPVP

SEQ ID NO: 2570 - protein, 69 aa, Homo Sapiens
  Normal prostate
  SIGNAL -24..-1: Von Heijne matrix; score 7.90; seq LLLPRVLLTMASG/SP
MPALLPVASRLLLLPRVLLTMASGSPPTQPSPASDSGSGYVPGSVSAAFVTCPNEKVAKEIARAVGEKR

SEQ ID NO: 2571 - protein, 119 aa, Homo Sapiens
  Normal prostate
  SIGNAL -108..-1: Von Heijne matrix
  score 7.90
  seq LLGLLSAEQLAEA/SV
  UNSURE -16: Xaa = Gly,Arg
  UNSURE -17: Xaa = Phe,Leu
MCLLLGATGVGKTLLVKRLQEVSSRDGKGDLGEPPPTRPTVGTNLTDIVAQRKITIRELGGCMGPIWSSYYGNCRSLLFVMDASDPTQLSAXXVQLLGLLSAEQLAEASVLILFNKIDN

SEQ ID NO: 2572 - protein, 54 aa, Homo Sapiens
  Normal prostate
  SIGNAL -41..-1: Von Heijne matrix; score 7.70; seq LLCLGQLHHPGLG/RV
MELPAVNLESDSPRSLAADNLGLHCILRLLCLGQLHHPGLGRVGCGSAGLHRRR

SEQ ID NO: 2573 - protein, 53 aa, Homo Sapiens
  Normal prostate
  SIGNAL -51..-1: Von Heijne matrix; score 7.60; seq PALILLFALGSLG/SG
MAFLRKVYSILSLQVLLTTVTSTVFLYFESVRTFVHESPALILLFALGSLGSG

SEQ ID NO: 2574 - protein, 61 aa, Homo Sapiens
  Cancerous prostate
  SIGNAL -29..-1: Von Heijne matrix; score 7.60; seq PTLAIALAANAWA/FV
MYTYGNKQHNSPTWDDPTLAIALAANAWAFVLFYVIPEVSQVTKSSPEQSYQGDMYPTRDL

SEQ ID NO: 2575 - protein, 42 aa, Homo Sapiens
  Normal prostate
  SIGNAL -32..-1: Von Heijne matrix; score 7.60; seq WILVLALPLTVWP/WL
MQQIFIQQCRELNFWSREPWILVLALPLTVWPWLSPEAQPPL

SEQ ID NO: 2576 - protein, 88 aa, Homo Sapiens
  Cancerous prostate
  SIGNAL -15..-1: Von Heijne matrix
  score 7.50
  seq AVLLALLMAGLAL/QP
  UNSURE 58: Xaa = Asp,His
  UNSURE 16: Xaa = Gly,Ser
  UNSURE 12: Xaa = Lys,Arg
MKAVLLALLMAGLALQPGTALLCYSWXAQVXNEDCLQVENCTQLGEQCWTARIRAVGLLTVISKGCSLNCVDXSQDYYVGKKNITCCD

SEQ ID NO: 2577 - protein, 82 aa, Homo Sapiens
  Normal prostate
  SIGNAL -16..-1: Von Heijne matrix; score 7.10; seq QACLLGLFALILS/GK
MGLQACLLGLFALILSGKCSYSPEPDQRRTLPPGWVSLGRADPEEELSLTFALRQQNVERLSELVQAVSDPSSPQYGKYLTR

SEQ ID NO: 2578 - protein, 127 aa, Homo Sapiens
  Cancerous prostate
  SIGNAL -29..-1: Von Heijne matrix
  score 7.00
  seq LGSGLGLSPGTSS/GR
  UNSURE 68: Xaa = Ala,Thr
  UNSURE 78: Xaa = Asn,Thr
  UNSURE 15: Xaa = Asp,Gly
  UNSURE 83: Xaa = Leu,Val
  UNSURE 18: Xaa = Phe,Ile,Val
  UNSURE 16: Xaa = Pro,Ser
MRPGQVSLLGPDAVSVLGSGLGLSPGTSSGRNPDPGSGPGTLPXXSXQNPSPAPDPPPALLLWNLLTQRLGTTLVPTLCPAQTLILCPAQTLILCPXLIPTLCPALXPVLPXVALSAQPSLPARVQS

SEQ ID NO: 2579 - protein, 43 aa, Homo Sapiens
  Cancerous prostate
  SIGNAL -33..-1: Von Heijne matrix; score 6.80; seq FTSASLLLPMSTG/MP
MINPSVPSKSNSHPFLSTVMFTSASLLLPMSTGMPTQNCFTPK

SEQ ID NO: 2580 - protein, 108 aa, Homo Sapiens
  Cancerous prostate
  SIGNAL -68..-1: Von Heijne matrix
  score 6.70
  seq IACLAWWIGGGSG/XN
  UNSURE -63: Xaa = Asn,Ser,Thr
  UNSURE 1: Xaa = any one of the twenty amino acids
MSEKEXNFPPLPKFIPVKPCFYQNFSDEIPVEHQVLVKRIYRLWMFYCATLGVNLIACLAWWIGGGSGXNFGLAFVWLLLFTPCGYVCWFRPVYKAFRADSSFNFMAL

SEQ ID NO: 2581 - protein, 63 aa, Homo Sapiens
  Normal prostate
  SIGNAL -23..-1: Von Heijne matrix
  score 6.70
  seq ILRLYFFLQLAHS/GY
  UNSURE 32: Xaa = Glu,Gly
  UNSURE 24: Xaa = Ser,Thr
MNPTKLILKTILRLYFFLQLAHSGYTKLQKKYMKSRYEQVDLVGKMXQKAATTVXHLAIQCHW

SEQ ID NO: 2582 - protein, 123 aa, Homo Sapiens
  Normal prostate
  SIGNAL -23..-1: Von Heijne matrix
  score 6.70
  seq SXXCFVSVPPASA/IP
  UNSURE 8: Xaa =  * ,Ala,Cys,Asp,Glu,Phe,Gly,His,Ile,Lys,Leu,Asn,Pro,Gln,Arg,Ser,Thr,Val,Tyr
  UNSURE 65: Xaa = Ala,Asp,Glu
  UNSURE 3: Xaa = Ala,Gly
  UNSURE -11: Xaa = Asp,His,Asn,Tyr
  UNSURE -12: Xaa = Cys,Trp
  UNSURE 12: Xaa = Gly,Arg
  UNSURE 87: Xaa = Gly,Val
  UNSURE 5: Xaa = Ile,Ser
  UNSURE 6: Xaa = Phe,Leu
MASSSPDSPCSXXCFVSVPPASAIPXVXXAXNSDXPRDEVQEVVFVPAGTHTPGSRLQCTYIEVEQVSKTHAVILSRPSWLWGAEMGXTSMVSALATRLCGRRSQLGRAXALLGMDLLRCRPC

SEQ ID NO: 2583 - protein, 46 aa, Homo Sapiens
  Normal prostate
  SIGNAL -39..-1: Von Heijne matrix
  score 6.70
  seq XLIAXLEPPGAMA/VR
  UNSURE -38: Xaa = Ala,Gly
  UNSURE -9: Xaa = Ile,Leu,Val
  UNSURE -13: Xaa = Phe,Leu
MXPVLAALAHVLCPYMAPGLCREPIRXLIAXLEPPGAMAVRRLPSA

SEQ ID NO: 2584 - protein, 85 aa, Homo Sapiens
  Hypertrophic prostate
  SIGNAL -45..-1: Von Heijne matrix
  score 6.70
  seq PMLGLAAFRWIWS/RE
  UNSURE 35: Xaa = Asp,Glu
MNNLNDPPNWNIRPNSRADGGDGSRWNYALLVPMLGLAAFRWIWSRESQKEVEKEREAYRRRTAAFQQDLEAKYHAMISXNRRAV

SEQ ID NO: 2585 - protein, 29 aa, Homo Sapiens [sequence omitted]

SEQ ID NO: 2586 - protein, 59 aa, Homo Sapiens
  Normal prostate
  SIGNAL -47..-1: Von Heijne matrix; score 6.50; seq IIVCLFAFLVAHC/FL
MLFLGKVLIVCSTGLAGIMLLNYQQDYTVWVLPLIIVCLFAFLVAHCFLSIYEMVVDAR

SEQ ID NO: 2587 - protein, 43 aa, Homo Sapiens
  Cancerous prostate
  SIGNAL -38..-1: Von Heijne matrix; score 6.30; seq LLLLVHSFWFTVC/TP
MQGIPILTPVTTQSIAISIVLTVQGLLLLVHSFWFTVCTPVVF

SEQ ID NO: 2588 - protein, 54 aa, Homo Sapiens
  Normal prostate
  SIGNAL -27..-1: Von Heijne matrix; score 6.30; seq LFCVLLSLRPHTS/GT
MQNFCHHLAICTVILFCVLLSLRPHTSGTLWASSAHGLHLAPAEPQLSCWMCCA

SEQ ID NO: 2589 - protein, 135 aa, Homo Sapiens
  Cancerous prostate
  SIGNAL -64..-1: Von Heijne matrix
  score 6.30
  seq VLMRLVASAYSIA/QK
  UNSURE -46: Xaa = Ala,Asp,His,Asn,Pro,Thr
  UNSURE 51: Xaa = Ala,Glu,Gly,Ile,Lys,Met,Arg,Thr,Val
  UNSURE 44: Xaa = Ala,Val
  UNSURE 71: Xaa = Arg,Ser
  UNSURE -38: Xaa = Asp,Asn
  UNSURE -45: Xaa = Glu,Gly
  UNSURE 45: Xaa = Gly,Arg,Trp
  UNSURE -35: Xaa = Leu,Val
  UNSURE -43: Xaa = Pro,Thr
MPSFSKDLLTVPKLGTGHXXGXGSYDXALXLLLKCLWSNVVPECTMASSNTVLMRLVASAYSIAQKAGMIVRRVIAEGDLGIVEKTCATDLQTKADRLAQMSICSSLXXKFPKLXIIGEEDLPSEEVDQELIEDX

SEQ ID NO: 2590 - protein, 28 aa, Homo Sapiens
  Hypertrophic prostate
  SIGNAL -21..-1: Von Heijne matrix
  score 6.20
  seq LEMLXAFASHIXA/RD
  UNSURE -2: Xaa = Arg,Trp
  UNSURE -9: Xaa = Ile,Lys,Asn,Arg,Ser,Thr
MRGAHLTALEMLXAFASHIXARDAAGSG

SEQ ID NO: 2591 - protein, 141 aa, Homo Sapiens
  Cancerous prostate
  SIGNAL -139..-1: Von Heijne matrix
  score 6.20
  seq FGLLHQLSQCVTS/LE
  UNSURE -35: Xaa =  * ,Ala,Glu,Gly,Lys,Leu,Met,Pro,Gln,Arg,Ser,Thr,Val,Trp
  UNSURE -97: Xaa = Ala,Thr
  UNSURE -42: Xaa = Asp,Glu
MEVGLPAITLFLTSASSPVVATTMDQEPVGGVERGEAVAASGXAAAAAFGESAGQMSNERGFENVELGVIGKKKKVPRRVIHFVSGETMEEYSTDEDXVDGLEKXMFCLLLIRQNLPGVPTYGFTCFGLLHQLSQCVTSLE

SEQ ID NO: 2592 - protein, 57 aa, Homo Sapiens
  Cancerous prostate
  SIGNAL -43..-1: Von Heijne matrix; score 6.10; seq SAATLASLGGTSS/RR
MKELERQQKEVEERPEKDFTEKGSRNMPGLSAATLASLGGTSSRRGSGDTSISIDPE

SEQ ID NO: 2593 - protein, 92 aa, Homo Sapiens
  Normal prostate
  SIGNAL -21..-1: Von Heijne matrix; score 6.10; seq VLVILCIVTVCVT/IV
MSMGFMMLVLVILCIVTVCVTIVCTYFLLNAEDYRWQWTSFLSAASTAIYVYMYSFYYYFFKTKMYGLFQTSFYFGYMAVFSTALGIMCGAI

SEQ ID NO: 2594 - protein, 113 aa, Homo Sapiens
  Normal prostate
  SIGNAL -70..-1: Von Heijne matrix
  score 6.00
  seq LLFPLTLVRSFWS/DM
  UNSURE 22: Xaa = Ala,Asp
  UNSURE -66: Xaa = Asp,Glu,Gly
  UNSURE 28: Xaa = Cys,Phe
  UNSURE -57: Xaa = Cys,Trp
  UNSURE -62: Xaa = Glu,Gly
  UNSURE -59: Xaa = Gly,Leu,Val,Trp
  UNSURE 10: Xaa = Ile,Arg
  UNSURE -63: Xaa = Ile,Ser
  UNSURE 24: Xaa = Lys,Gln
MMELXLKXXTKXEXESACTEAYSQSDEQYACHLGCQNQLPFAELRQEQLMSLMPKMHLLFPLTLVRSFWSDMMDSAQSFXTSSWTFYLQADXGXIVIXQSKPEIQYAPHLEQE

SEQ ID NO: 2595 - protein, 27 aa, Homo Sapiens
  Normal prostate
  SIGNAL -24..-1: Von Heijne matrix; score 6.00; seq GLILLFASHLINQ/FS
MVSNASETSCLGLILLFASHLINQFSS

SEQ ID NO: 2596 - protein, 124 aa, Homo Sapiens
  Hypertrophic prostate
  SIGNAL -73..-1: Von Heijne matrix
  score 6.00
  seq LIVFISVCTALLA/EG
  UNSURE 48: Xaa = Ala,Thr
  UNSURE 45: Xaa = Asp,His
  UNSURE -29: Xaa = Leu,Met,Val
  UNSURE 36: Xaa = Ser,Thr
MPRKRKCDLRAVRVGLLLGGGGVYGSRFRFTFPGCRALSPWRVRXQRRRCEMSTMFADTLLIVFISVCTALLAEGITWVLVYRTDKYKRLKAEVEKQSKKYLMVEWWQXFLFYPSFLXPKXVSS

SEQ ID NO: 2597 - protein, 106 aa, Homo Sapiens
  Hypertrophic prostate
  SIGNAL -23..-1: Von Heijne matrix; score 5.90; seq LGAAALALLLANT/DV
MGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEQR

SEQ ID NO: 2598 - protein, 58 aa, Homo Sapiens
  Hypertrophic prostate
  SIGNAL -31..-1: Von Heijne matrix
  score 5.90
  seq LPLLLVANAGTAA/VG
  UNSURE -24: Xaa = Ile,Lys,Arg
MDVAFLEXLIKDDIERGRLPLLLVANAGTAAVGHTDKIGRLKELCEQYGIWLHVEGVN

SEQ ID NO: 2599 - protein, 18 aa, Homo Sapiens
  Hypertrophic prostate
  SIGNAL -16..-1: Von Heijne matrix; score 5.80; seq LFNLLWLALACSP/VW
MRTLFNLLWLALACSPVW

SEQ ID NO: 2600 - protein, 39 aa, Homo Sapiens
  Normal prostate
  SIGNAL -33..-1: Von Heijne matrix
  score 5.80
  seq FICLQWALPHSEA/GD
  UNSURE -16: Xaa = His,Gln
  UNSURE -26: Xaa = Ile,Lys
MNAQPGLXLDCITRFLTXGQFICLQWALPHSEAGDFEAK

SEQ ID NO: 2601 - protein, 78 aa, Homo Sapiens
  Normal prostate
  SIGNAL -69..-1: Von Heijne matrix; score 5.70; seq LCRLLCLVRLFCC/SS
MGKEWGWQEMENGGAAPAWGAGPPVHPAPPPVEKTLSWGCGFGLHSGFGGSGGGVGLCRLLCLVRLFCCSSILYQRQK

SEQ ID NO: 2602 - protein, 33 aa, Homo Sapiens
  Hypertrophic prostate
  SIGNAL -29..-1: Von Heijne matrix; score 5.70; seq AALLLTATVRLSA/SP
MAAPSGGWNGVGASLWAALLLTATVRLSASPGP

SEQ ID NO: 2603 - protein, 130 aa, Homo Sapiens
  Cancerous prostate
  SIGNAL -48..-1: Von Heijne matrix
  score 5.70
  seq LLLFFGKLLVVGG/VG
  UNSURE 32: Xaa = Ile,Thr
MIAIYGKNFCVSAKNAFMLLMRNIVRVVVLDKVTDLLLFFGKLLVVGGVGVLSFFFFSGRIPGLGKDFKSPHLNYYWLPXMTSILGAYVIASGFFSVFGMCVDTLFLCFLEDLERTTAPWTALLHVQELL

SEQ ID NO: 2604 - protein, 96 aa, Homo Sapiens
  Cancerous prostate
  SIGNAL -91..-1: Von Heijne matrix
  score 5.70
  seq SVLELIVASVCQS/HI
  UNSURE -53: Xaa = Asp,Glu,Gly
  UNSURE -72: Xaa = Glu,Gly
MERNCKGSFGVIKEGDTDTXETKARRTVWEPRGRYSFRXTPRPAYPVEQCGFARRALELLEIRKHSPEVCEPPNIPVTSVLELIVASVCQSHIRTT

SEQ ID NO: 2605 - protein, 93 aa, Homo Sapiens
  Normal prostate
  SIGNAL -66..-1: Von Heijne matrix; score 5.70; seq LYMLAEALPVSHG/AH
MFVEYRKQLKLLLDRLAQVSPELLLASVRRVFSSTLQNWQTTRFMEVEVAIRLLYMLAEALPVSHGAHFSGDVSKASALQDMMRTLVTSGVSG

SEQ ID NO: 2606 - protein, 23 aa, Homo Sapiens
  Normal prostate
  SIGNAL -21..-1: Von Heijne matrix; score 5.70; seq IIFLIQWHGSVFQ/EF
MLLGTSNIIIFLIQWHGSVFQEF

SEQ ID NO: 2607 - protein, 54 aa, Homo Sapiens
  Cancerous prostate
  SIGNAL -20..-1: Von Heijne matrix
  score 5.60
  seq AFVXACVLSLIST/IY
  UNSURE -19: Xaa = Asp,Gly
  UNSURE -10: Xaa = Ile,Met
MXNRFATAFVXACVLSLISTIYMAASIGTDFWYEYRSPVQENSSDLNKSIWDEL

SEQ ID NO: 2608 - protein, 19 aa, Homo Sapiens
  Normal prostate
  SIGNAL -13..-1: Von Heijne matrix; score 5.60; seq MSLTSGFLRVSQG/SP
MSLTSGFLRVSQGSPNLSQ

SEQ ID NO: 2609 - protein, 86 aa, Homo Sapiens
  Cancerous prostate
  SIGNAL -63..-1: Von Heijne matrix; score 5.60; seq AIRTLFSVTGILA/EQ
MANFKGHALPGSFFLIIGLCWSVKYPLKYFSHTRKNSPLHYYQRLEIVEAAIRTLFSVTGILAEQFVPDGPHLHLYHENHWIKLMN

SEQ ID NO: 2610 - protein, 73 aa, Homo Sapiens
  Normal prostate
  SIGNAL -52..-1: Von Heijne matrix; score 5.50; seq AGLLFGSLAGLGA/YQ
MQDTGSVVPLHWFGFGYAALVASGGIIGYVKAGSVPSLAAGLLFGSLAGLGAYQLSQDPRNVWVFLATSGTLA

SEQ ID NO: 2611 - protein, 47 aa, Homo Sapiens
  Cancerous prostate
  SIGNAL -35..-1: Von Heijne matrix
  score 5.40
  seq CCALLTSLXCIWG/PA
  UNSURE -5: Xaa =  * ,Trp
  UNSURE -18: Xaa = Asp,Gly
  UNSURE -16: Xaa = Cys,Phe,Gly,Ile,Leu,Arg,Ser,Val
  UNSURE -33: Xaa = Ile,Arg
  UNSURE -15: Xaa = Lys,Arg
  UNSURE -17: Xaa = Phe,Leu
MEXGLKSADPRDGTGYTXXXXYCCALLTSLXCIWGPAYLQLAHGYVK

SEQ ID NO: 2612 - protein, 77 aa, Homo Sapiens
  Normal prostate
  SIGNAL -42..-1: Von Heijne matrix; score 5.40; seq ITGVILLAVGIWG/KV
MASPSRRLQTKPVITCFKSVLLIYTFIFWITGVILLAVGIWGKVSLENYFSLLNEKATNVPFVLIATGTVIILLGTL

SEQ ID NO: 2613 - protein, 89 aa, Homo Sapiens
  Cancerous prostate
  SIGNAL -67..-1: Von Heijne matrix
  score 5.20
  seq LSVSLLPCAGAWS/LL
  UNSURE 3: Xaa = Gly,Ser
  UNSURE 17: Xaa = Pro,Thr
MFSRELAPTRIGGASSGSRSGGTLISTAPLTTRVLNPTAQCFCLDCTLRRMQTHLSVSLLPCAGAWSLLXSKKVILPSCSSILXTVVVI

SEQ ID NO: 2614 - protein, 54 aa, Homo Sapiens
  Hypertrophic prostate
  SIGNAL -29..-1: Von Heijne matrix
  score 5.10
  seq LLMLGVTLPNSYW/RV
  UNSURE 11,14: Xaa = Ile,Asn,Thr
MSMAVETFGFFMATVGLLMLGVTLPNSYWRVSTVHGNVIXTNXIFENLWFSSAG

SEQ ID NO: 2615 - protein, 56 aa, Homo Sapiens
  Hypertrophic prostate
  SIGNAL -20..-1: Von Heijne matrix
  score 5.00
  seq XFLXLXXLSXXWP/XD
  UNSURE -4: Xaa =  * ,Lys,Asn,Tyr
  UNSURE -7: Xaa = Ala,Gly
  UNSURE 1: Xaa = Ala,Gly,Pro,Arg
  UNSURE -13,18: Xaa = Ala,Pro
  UNSURE -8: Xaa = Ala,Val
  UNSURE -10: Xaa = His,Leu,Arg
  UNSURE -3: Xaa = Ile,Ser
  UNSURE 10: Xaa = Lys,Thr
MEKIPVSXFLXLXXLSXXWPXDTTVKPGAXKDTKDSRXKLPQTLSRGWGDQLIWTR

SEQ ID NO: 2616 - protein, 85 aa, Homo Sapiens
  Normal prostate
  SIGNAL -67..-1: Von Heijne matrix
  score 5.00
  seq LILERPLVPSAEA/SG
  UNSURE -59: Xaa =  * ,Tyr
MHSAEEPLXLAALRGARGHLPCGSRHHVGSLAPASVPAPGACLWVCEWETLLPGLILERPLVPSAEASGAGKLSRKEALLSNYAL

SEQ ID NO: 2617 - protein, 50 aa, Homo Sapiens
  Hypertrophic prostate
  SIGNAL -43..-1: Von Heijne matrix
  score 4.90
  seq GLWLALVDGLVRX/AP
  UNSURE 6: Xaa = Ala,Pro
  UNSURE -1: Xaa = Arg,Thr
MAGQFRSYVWDPLLILSQIVLMQTVYYGSLGLWLALVDGLVRXAPRWIXG

SEQ ID NO: 2618 - protein, 90 aa, Homo Sapiens
  Cancerous prostate
  SIGNAL -78..-1: Von Heijne matrix; score 4.90; seq VGAVFGLTTCISA/HV
MAPKVFRQYWDIPDGTDCHRKAYSTTSIASVAGLTAAAYRVTLNPPGTFLEGVAKVGQYTFTAAAVGAVFGLTTCISAHVREKPDDPLNR

SEQ ID NO: 2619 - protein, 22 aa, Homo Sapiens
  Cancerous prostate
  SIGNAL -18..-1: Von Heijne matrix; score 4.90; seq WLQVLPVILLLLG/VP
MAAAAWLQVLPVILLLLGVPPS

SEQ ID NO: 2620 - protein, 41 aa, Homo Sapiens [sequence omitted]

SEQ ID NO: 2621 - protein, 50 aa, Homo Sapiens
  Hypertrophic prostate
  SIGNAL -31..-1: Von Heijne matrix; score 4.80; seq VLLAIGMFFTAWF/FV
MSRYTSPVNPAVFPHLTVVLLAIGMFFTAWFFVYEVTSTKYTRDIYKELQ

SEQ ID NO: 2622 - protein, 38 aa, Homo Sapiens
  Cancerous prostate
  SIGNAL -35..-1: Von Heijne matrix; score 4.80; seq LMLSSSLPLLIWL/KD
MRLAAEAHPGRTHTLFRRLKPFLMLSSSLPLLIWLKDR

SEQ ID NO: 2623 - protein, 55 aa, Homo Sapiens
  Prostate
  SIGNAL -39..-1: Von Heijne matrix
  score 4.80
  seq IILFSAIVGFIYG/YV
  UNSURE -19: Xaa = Glu,Gly
  UNSURE -34: Xaa = Gly,Ser
MLEHLXSLPTQMDYKGQKLAXQMFQGIILFSAIVGFIYGYVAEQFGWTVYIVMAG

SEQ ID NO: 2624 - protein, 19 aa, Homo Sapiens
  Normal prostate
  SIGNAL -16..-1: Von Heijne matrix; score 4.80; seq SKVLFCSFSNVLG/FD
MEYSKVLFCSFSNVLGFDY

SEQ ID NO: 2625 - protein, 60 aa, Homo Sapiens
  Prostate
  SIGNAL -26..-1: Von Heijne matrix; score 4.70; seq LIMQLGSVLLTRC/PF
MASKIGSRRWMLQLIMQLGSVLLTRCPFWGCFSQLMLYAERAEARRKPDIPVPYLYFDSG

SEQ ID NO: 2626 - protein, 79 aa, Homo Sapiens
  Normal prostate
  SIGNAL -52..-1: Von Heijne matrix; score 4.70; seq LGLALGRLEGGSA/RH
MEHYRKAGSVELPAPSPMPQLPPDTLEMRVRDGSKIRNLLGLALGRLEGGSARHVVFSGSGRAAGKAVSCAEIVKRRVP

SEQ ID NO: 2627 - protein, 73 aa, Homo Sapiens
  Hypertrophic prostate
  SIGNAL -26..-1: Von Heijne matrix
  score 4.60
  seq LIALTCLDGTTVS/AE
  UNSURE 46: Xaa = Ala,Asp,Gly,Val
MNALMVLFNVTVVLIALTCLDGTTVSAEMATMTMGCFHQVENRVKILMSVGPGGTAVPMIPFASIWMADMIXD

SEQ ID NO: 2628 - protein, 49 aa, Homo Sapiens
  Hypertrophic prostate
  SIGNAL -45..-1: Von Heijne matrix; score 4.60; seq VLVYLVTAERVWS/DD
MNWSIFEGLLSGVNKYSTAFGRIWLSLVFIFRVLVYLVTAERVWSDDHK

SEQ ID NO: 2629 - protein, 53 aa, Homo Sapiens
  Prostate
  SIGNAL -16..-1: Von Heijne matrix
  score 4.50
  seq SLFIYIFXTCSNT/SP
  UNSURE 6: Xaa =  * ,Gly
  UNSURE 35: Xaa = Leu,Val
  UNSURE -6: Xaa = Phe,Leu
MIISLFIYIFXTCSNTSPSYQXTQLGLGLPSAQWWPLTGRRMQCCRLFCFXLQ

SEQ ID NO: 2630 - protein, 32 aa, Homo Sapiens
  Normal prostate
  SIGNAL -16..-1: Von Heijne matrix; score 4.40; seq LNSLSALAELAVG/SR
MFRLNSLSALAELAVGSRWYHGGSQPIQIRRR

SEQ ID NO: 2631 - protein, 44 aa, Homo Sapiens
  Cancerous prostate
  SIGNAL -17..-1: Von Heijne matrix
  score 4.40
  seq TLRTWLCCAGSWA/VE
  UNSURE 13: Xaa = Lys,Met
MTAGTLRTWLCCAGSWAVELPAEPLVVFCXSTSRKRAKGLIQSV

SEQ ID NO: 2632 - protein, 26 aa, Homo Sapiens [sequence omitted]

SEQ ID NO: 2633 - protein, 32 aa, Homo Sapiens
  Normal prostate
  SIGNAL -28..-1: Von Heijne matrix; score 4.20; seq LQFVLPVATQIQQ/EV
MDEARDNACNDMGKMLQFVLPVATQIQQEVIK

SEQ ID NO: 2634 - protein, 23 aa, Homo Sapiens
  Normal prostate
  SIGNAL -21..-1: Von Heijne matrix; score 4.20; seq LCALGSAPSSMWA/GE
MSPISIRELCALGSAPSSMWAGE

SEQ ID NO: 2635 - protein, 69 aa, Homo Sapiens
  Normal prostate
  SIGNAL -13..-1: Von Heijne matrix
  score 4.20
  seq MTDLLSASPWALT/IV
  UNSURE 56: Xaa = Arg,Trp
MTDLLSASPWALTIVSSELHLAPSMTTVDQLESQVDNVILQTGESASECFCLQCPSLGNIEGGVATGHX

SEQ ID NO: 2636 - protein, 70 aa, Homo Sapiens
  Normal prostate
  SIGNAL -26..-1: Von Heijne matrix; score 4.20; seq LTCGPALVPRLWA/TC
MSWSGLLHGLNTSLTCGPALVPRLWATCSMATLNQMHRLGPPKRPPRKLGPTEGRPQLKGVVLCTFTRNR

SEQ ID NO: 2637 - protein, 67 aa, Homo Sapiens
  Cancerous prostate
  SIGNAL -23..-1: Von Heijne matrix; score 4.10; seq LEAFSQAISAIQA/LR
MADVINVSVNLEAFSQAISAIQALRSSVSRVFDCLKDGMRNKETLEGREKAFIAHFQDNLHSVNRDP

SEQ ID NO: 2638 - protein, 77 aa, Homo Sapiens
  Cancerous prostate
  SIGNAL -32..-1: Von Heijne matrix; score 4.10; seq RLLSSLLLTMSNN/NP
MNVIDHVRDMAAAGLHSNVRLLSSLLLTMSNNNPELFSPPQKYQLLVYHADSLFHDKEYRNAVSKYTMALQQKKALS

SEQ ID NO: 2639 - protein, 24 aa, Homo Sapiens
  Normal prostate
  SIGNAL -16..-1: Von Heijne matrix; score 4.10; seq ACLAWTAVRPSAC/CH
MTSACLAWTAVRPSACCHPQSANW

SEQ ID NO: 2640 - protein, 77 aa, Homo Sapiens
  Hypertrophic prostate
  SIGNAL -55..-1: Von Heijne matrix
  score 4.00
  seq VFGMSSSSGASNS/AP
  UNSURE -26: Xaa = Ala,Gly,Pro,Arg
MNGSRTLTHSISDGQLQGGQSNSELFQQEXQTAPAQVPQGFNVFGMSSSSGASNSAPHLGFHLGSKGTSSLSQQTPG

SEQ ID NO: 2641 - protein, 47 aa, Homo Sapiens
  Normal prostate
  SIGNAL -16..-1: Von Heijne matrix; score 4.00; seq FFLFLSFVLMYDG/LR
MLGFFLFLSFVLMYDGLRLFGILSTCRVHHTMNQFLIDISSFTSRVR

SEQ ID NO: 2642 - protein, 48 aa, Homo Sapiens
  Hypertrophic prostate
  SIGNAL -27..-1: Von Heijne matrix; score 4.00; seq SIKVLLQSALSLG/RS
MMEERANLMHMMKLSIKVLLQSALSLGRSLDADHAPLQQFFVVMEHCS

SEQ ID NO: 2643 - protein, 80 aa, Homo Sapiens
  Normal prostate
  SIGNAL -17..-1: Von Heijne matrix
  score 3.90
  seq XIVSAALLAFVQT/HL
  UNSURE 47: Xaa =  * ,Tyr
  UNSURE 61: Xaa = Asp,Glu
  UNSURE 19: Xaa = Leu,Arg
  UNSURE -13: Xaa = Met,Arg
MELEXIVSAALLAFVQTHLPEADLSGLDEVIFSYVXGVLEDLGPSGPSEENFDMEAFTEMMEAXVPGFAHIPRGTIGXMM

SEQ ID NO: 2644 - protein, 59 aa, Homo Sapiens
  Hypertrophic prostate
  SIGNAL -26..-1: Von Heijne matrix
  score 3.90
  seq SLIPLFXFIGTGA/TG
  UNSURE 16: Xaa = Asp,Gly
  UNSURE 22: Xaa = Asp,Gly,Asn,Ser
  UNSURE 29: Xaa = Glu,Gly,Lys,Arg
  UNSURE -7: Xaa = Leu,Val
MLRQIIGQAKKHPSLIPLFXFIGTGATGATLYLLRLALFNPXVCWDRXNPEPWNXLGPE

SEQ ID NO: 2645 - protein, 100 aa, Homo Sapiens
  Cancerous prostate
  SIGNAL -98..-1: Von Heijne matrix
  score 3.80
  seq WTSLTCSLVVVDG/CG
  UNSURE -27: Xaa =  * ,Cys,Phe,Leu,Ser,Trp
MVKETQYYDILGVKPSASPERSRRPIGSWRSSTTRTRTRMRARSLNSYPRHMKCFQIQRKGMFMTKAESRQXKKEAQAAPASLHPWTSLTCSLVVVDGCG

SEQ ID NO: 2646 - protein, 113 aa, Homo Sapiens
  Normal prostate
  SIGNAL -36..-1: Von Heijne matrix
  score 3.80
  seq RALSTXLFGSIRG/AA
  UNSURE 68: Xaa =  * ,Tyr
  UNSURE -8: Xaa = Phe,Ile,Leu,Val
MANLFIRKMVNPLLYLSRHTVKPRALSTXLFGSIRGAAPVAVEPGAAVRSLLSPGLLPHLLPALGFKNKTVLKKRCKDCYLVKRRGRWYVYCKTHPRHKQRHMXTLSLQSHAQ

SEQ ID NO: 2647 - protein, 37 aa, Homo Sapiens
  Cancerous prostate
  SIGNAL -32..-1: Von Heijne matrix
  score 3.70
  seq RIHLCQRSPGSQG/VR
  UNSURE -15: Xaa = Asp,Glu
  UNSURE -23: Xaa = Phe,Val
MAAAAASRGXGAKLGLRXIRIHLCQRSPGSQGVRDFI

SEQ ID NO: 2648 - protein, 65 aa, Homo Sapiens
  Cancerous prostate
  SIGNAL -44..-1: Von Heijne matrix; score 3.70; seq IALTLIPSMLSRA/AG
MFPSCYLCYSLCGSILLSIFSAYNRLSLMLRIALTLIPSMLSRAAGWCWYKEPTQQFSYLCLPCG

SEQ ID NO: 2649 - protein, 65 aa, Homo Sapiens
  Cancerous prostate
  SIGNAL -60..-1: Von Heijne matrix
  score 3.70
  seq QLXFLYFVCCIFQ/DV
  UNSURE -56: Xaa = Asp,Glu
  UNSURE 5: Xaa = Phe,Leu,Val
  UNSURE -11: Xaa = Ser,Tyr
MSTQXGLSMHAHPQAYTPFIYLHARKRRGEIGDADSRFNDRYAHKSAQLXFLYFVCCIFQDVYYX

SEQ ID NO: 2650 - protein, 39 aa, Homo Sapiens [sequence omitted]

SEQ ID NO: 2651 - protein, 90 aa, Homo Sapiens
  Hypertrophic prostate
  SIGNAL -62..-1: Von Heijne matrix
  score 3.70
  seq SILGIISVPLSIG/YC
  UNSURE -20: Xaa =  * ,Gly,Leu,Val
  UNSURE 9: Xaa = Arg,Trp
  UNSURE 18: Xaa = Asp,Glu
  UNSURE 14: Xaa = Asp,Glu,Gly,Ile,Lys,Asn,Arg,Ser,Val
  UNSURE -46,5: Xaa = Glu,Lys
  UNSURE -21: Xaa = His,Gln
MSQRSLCMDTSLDVYRXLIELNYLGTVSLTKCVLPHMIERKXXKIVTVNSILGIISVPLSIGYCASXHALXGFFNXLRTXLATYPGIIVS

SEQ ID NO: 2652 - protein, 120 aa, Homo Sapiens
  Cancerous prostate
  SIGNAL -98..-1: Von Heijne matrix
  score 3.60
  seq LALRTSWISSVCS/VT
  UNSURE -55: Xaa = Arg,Ser,Thr
  UNSURE -54: Xaa = Gly,Arg,Trp
MGGSGSRLSKELLAEYQDLTFLTKQEILLAHRRFCELLPQEQRXXSRHFGHKCPSSRFSAFQSSRPTPSRSESAGSSPHPQPKTALALRTSWISSVCSVTQPRQTSSPIMPSASLTLMMT

SEQ ID NO: 2653 - protein, 51 aa, Homo Sapiens
  Normal prostate
  SIGNAL -28..-1: Von Heijne matrix; score 3.60; seq PLSDSWALLPASA/GV
MWRLLARASAPLLRVPLSDSWALLPASAGVKTLLPVPSFEDVSIPEKPKLL

SEQ ID NO: 2654 - protein, 123 aa, Homo Sapiens
  Normal prostate
  SIGNAL -114..-1: Von Heijne matrix
  score 3.60
  seq ATFVTQALIQXYA/RI
  UNSURE -3: Xaa =  * ,Leu
  UNSURE -21: Xaa =  * ,Tyr
  UNSURE -90: Xaa = Ala,Gly,Ser,Thr
  UNSURE -85: Xaa = Glu,Gln
  UNSURE -89: Xaa = Ser,Thr
MADHVQSLAQLENLCKQLYETTDTXXRSSXAEKALVEFTNSPDCLSKCQLLLERGSSSYSQLLAATCLTKLVSRTNNPLPLEQRIDIRNYVLNXLATRPKLATFVTQALIQXYARITKLGWFD

SEQ ID NO: 2655 - protein, 59 aa, Homo Sapiens
  Hypertrophic prostate
  SIGNAL -55..-1: Von Heijne matrix; score 3.60; seq TCSVCCYLFWLIA/IP
MAYHGLTVPLIVMSVFWGFVGFLVPWFIPKGPNRGVIITMLVTCSVCCYLFWLIAIPAW

SEQ ID NO: 2656 - protein, 128 aa, Homo Sapiens
  Cancerous prostate
  SIGNAL -58..-1: Von Heijne matrix
  score 3.50
  seq GGILMGSFQGTIA/GQ
  UNSURE 50,57: Xaa = His,Gln
MSTGQLYRMEDIGRFHSQQPGSLTPSSPTVGEIIYNNTRNTLGWIGGILMGSFQGTIAGQGTGATSISELCKGQELEPSGAGLTVAPPQAVSLQGSHPALAATAFSLXCPRGVQXLMISISEHLFIHA

SEQ ID NO: 2657 - protein, 24 aa, Homo Sapiens
  Normal prostate
  SIGNAL -17..-1: Von Heijne matrix; score 3.50; seq RWWCFHLQAEASA/HP
MGWQRWWCFHLQAEASAHPPQGLQ

SEQ ID NO: 2658 - protein, 45 aa, Homo Sapiens
  Hypertrophic prostate
  SIGNAL -15..-1: Von Heijne matrix; score 3.50; seq VIFFACVVRVRDG/LP
MSVIFFACVVRVRDGLPLSASTDFYHTQDFLEWRRRLKSLALRLK

SEQ ID NO: 2659 - protein, 59 aa, Homo Sapiens
  Normal prostate
  SIGNAL -16..-1: Von Heijne matrix
  score 3.50
  seq TALAAXTWLGVWG/VR
  UNSURE 39: Xaa = Asp,Glu
  UNSURE 40: Xaa = Glu,Gln
  UNSURE 33: Xaa = Lys,Asn
  UNSURE -8: Xaa = Lys,Gln,Arg
MAVTALAAXTWLGVWGVRTMQARGFGSDQSENVDRGAGSIREAGGAFGXREQAEXXRYF

SEQ ID NO: 2660 - protein, 56 aa, Homo Sapiens
  Normal prostate
  SIGNAL -18..-1: Von Heijne matrix; score 12.00; seq FTLFLALIGGTSG/QY
MSLSAFTLFLALIGGTSGQYYDYDFPLSIYGQSSPNCAPECNCPESYPSAMYCDEL

SEQ ID NO: 2661 - protein, 23 aa, Homo Sapiens
  Normal prostate
  SIGNAL -18..-1: Von Heijne matrix; score 12.00; seq FTLFLALIGGTSG/QY
MSLSAFTLFLALIGGTSGQYYDW

SEQ ID NO: 2662 - protein, 96 aa, Homo Sapiens
  Hypertrophic prostate
  SIGNAL -18..-1: Von Heijne matrix; score 12.00; seq FTLFLALIGGTSG/QY
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLG

SEQ ID NO: 2663 - protein, 111 aa, Homo Sapiens
  Normal prostate
  SIGNAL -20..-1: Von Heijne matrix
  score 8.90
  seq LLLLLLPFLLYMA/AP
  UNSURE 52: Xaa =  * ,Cys,Phe,Leu,Ser,Trp,Tyr
  UNSURE 72: Xaa = Glu,Gln
  UNSURE 78: Xaa = Glu,Lys
  UNSURE 53: Xaa = Gly,Arg,Trp
  UNSURE 50: Xaa = Leu,Val
  UNSURE 63: Xaa = Lys,Arg
  UNSURE 71: Xaa = Lys,Asn
MVELMFPLLLLLLPFLLYMAAPQIRKMLSSGVCTSTVQLPGKVVVVTGANTGIGKETAKELAQRGARVYXAXXDVEKGELVAXEIQTTTGXXQVLVRXLDLSDTKSIRAFA

SEQ ID NO: 2664 - protein, 41 aa, Homo Sapiens
  Normal prostate
  SIGNAL -15..-1: Von Heijne matrix; score 8.10; seq LLYLLVPALFCRA/GG
MWLLYLLVPALFCRAGGSIPIPQKLFGEVTSPLFPKPYPNG

SEQ ID NO: 2665 - protein, 71 aa, Homo Sapiens
  Normal prostate
  SIGNAL -32..-1: Von Heijne matrix; score 7.70; seq LLFLVAGLLPSFP/AN
MKQILHPALETTAMTLFPVLLFLVAGLLPSFPANEDKDPAFTALLTTQTQVQREIVNKHNELRRAVSPPAK

SEQ ID NO: 2666 - protein, 138 aa, Homo Sapiens
  Cancerous prostate
  SIGNAL -17..-1: Von Heijne matrix
  score 6.90
  seq LFLTMLTLALVKS/QD
  UNSURE 88: Xaa = Ala,Cys,Asp,Phe,Gly,Ile,Asn,Ser,Thr,Val,Tyr
  UNSURE 94: Xaa = Ala,Gly,Val
  UNSURE 97: Xaa = His,Ile,Lys,Leu,Met,Asn,Pro,Gln,Arg,Ser,Thr
MLKALFLTMLTLALVKSQDTEETITYTQCTDGYEWDPVRQQCKDIDECDIVPDACKGGMKCVNHYGGYLCLPKTAQIIVNNEQPQQETQPAEGTSGATTGVVAAXSMATSXVLXGGGFVASAAAVAGPEMQTGRNNFV

SEQ ID NO: 2667 - protein, 69 aa, Homo Sapiens
  Normal prostate
  SIGNAL -22..-1: Von Heijne matrix; score 5.90; seq LLILWFHLDCVSS/IL
MEKNPLAAPLLILWFHLDCVSSILNVEQSPQSLHVQEGDSTNFTCSFPSSNFYALHWYRWETAKSPEAV

SEQ ID NO: 2668 - protein, 37 aa, Homo Sapiens
  Hypertrophic prostate
  SIGNAL -15..-1: Von Heijne matrix; score 5.30; seq VVTIVILLCFCKA/AE
MRVVTIVILLCFCKAAELRKASPGSVRSRVNHGRAGG

SEQ ID NO: 2669 - protein, 102 aa, Homo Sapiens
  Normal prostate
  SIGNAL -90..-1: Von Heijne matrix; score 5.10; seq LLFVATLPFWTHY/LI
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMC

SEQ ID NO: 2670 - protein, 125 aa, Homo Sapiens
  Testis
  SIGNAL -30..-1: Von Heijne matrix
  score 13.20
  seq LLLLSTLVIPSAA/AP
  UNSURE 78: Xaa =  * ,Ala,Glu,Gly,Lys,Leu,Met,Pro,Gln,Arg,Ser,Thr,Val,Trp
  UNSURE 73: Xaa = His,Asn
MGEASPPAPARRHLLVLLLLLSTLVIPSAAAPIHDADAQESSLGLTGLQSLLQGFSRLFLKGNLLRGIDSLFSAPMDFRGLPGNYHKEENQEHQLGNNTLSSXLQIDXMTDNKTGEVLISENVVA

SEQ ID NO: 2671 - protein, 48 aa, Homo Sapiens
  Testis
  SIGNAL -21..-1: Von Heijne matrix; score 12.00; seq VLVLCVLLLQAQG/GY
MAPQTLLPVLVLCVLLLQAQGGYRDKMRMQRIKVCEKRPSIDLCIHHR

SEQ ID NO: 2672 - protein, 101 aa, Homo Sapiens
  Testis
  SIGNAL -19..-1: Von Heijne matrix
  score 11.00
  seq SLVLLLCLTCSYA/FM
  UNSURE 46: Xaa = Phe,Val
MWTLKSSLVLLLCLTCSYAFMFSSLRQKTSEPQGKVQYGEHFRIRQNLPEHTQGWLGSKWLWLLXVVVPFVILQCQRDSEKNKEQSPPGLRGGQLHSPLKK

SEQ ID NO: 2673 - protein, 115 aa, Homo Sapiens
  Testis
  SIGNAL -16..-1: Von Heijne matrix
  score 10.60
  seq LLLLPLLWGGSLQ/EK
  UNSURE 92: Xaa = Ala,Pro
MLPLLLLPLLWGGSLQEKPVYELQVQKSVTVQEGLCVLVPCSFSYPWRSWYSSPPLYVYWFRDGEIPYYAEVVATNNPDRRVKPETQGRFRLLGDVQKKNCSLSIGDXRMEDTGG

SEQ ID NO: 2674 - protein, 64 aa, Homo Sapiens
  Ovary
  SIGNAL -26..-1: Von Heijne matrix; score 10.40; seq LLLLLCGPSQDQC/RP
METGALRRPQLLPLLLLLCGPSQDQCRPVLQNLLQSPGLTWSLEVPTGREGKEGTMRVSPTAPR

SEQ ID NO: 2675 - protein, 83 aa, Homo Sapiens
  Testis
  SIGNAL -16..-1: Von Heijne matrix; score 10.10; seq LVLTLCTLPLAVA/SA
MERLVLTLCTLPLAVASAGCATTPARNLSCYQCFKVSSWTECPPTWCSPLDQVCISNEVVVSFKWSVRVLLSKRCAPRCPNSG

SEQ ID NO: 2676 - protein, 120 aa, Homo Sapiens
  Testis
  SIGNAL -23..-1: Von Heijne matrix
  score 9.80
  seq FLLFFFLFLLTRG/SL
  UNSURE 15: Xaa = Ala,Cys,Gly,Ser,Trp
  UNSURE 16: Xaa = Cys,Gly
  UNSURE 17: Xaa = Ile,Met
MMLPQWLLLLFLLFFFLFLLTRGSLSPTKYNLLELKEXXXGNQDCETGCCQRAPDNCESHCAEKGSEGSLCQTQVFFGQYRACPCLRNLTCIYSKNEKWLSIAYGRCQKIGRQKLARKCS

SEQ ID NO: 2677 - protein, 28 aa, Homo Sapiens
  Testis
  SIGNAL -22..-1: Von Heijne matrix
  score 9.80
  seq LVVFCLALQLVPG/SP
  UNSURE -14: Xaa = Phe,Tyr
MKPVLPLQXLVVFCLALQLVPGSPKQLG

SEQ ID NO: 2678 - protein, 40 aa, Homo Sapiens
  Spleen
  SIGNAL -35..-1: Von Heijne matrix
  score 9.50
  seq LFFSLFSAPLASA/VR
  UNSURE 5: Xaa = Arg,Thr
MFRQRQETAQRSTQSCRCPRDGLFFSLFSAPLASAVRAAX

SEQ ID NO: 2679 - protein, 37 aa, Homo Sapiens [sequence omitted]

SEQ ID NO: 2680 - protein, 56 aa, Homo Sapiens
  Testis
  SIGNAL -23..-1: Von Heijne matrix
  score 9.40
  seq SLLFICFFGESFC/IC
  UNSURE 11: Xaa =  * ,Glu,Gly
  UNSURE 9: Xaa =  * ,Lys,Leu,Met
MSNQRLPLIFSLLFICFFGESFCICDGTVWTXVXWEILPEEVHYWKVKGSPSHCLR

SEQ ID NO: 2681 - protein, 20 aa, Homo Sapiens
  Ovary
  SIGNAL -16..-1: Von Heijne matrix; score 9.20; seq FLSFLLALLSLNC/IP
MLWFLSFLLALLSLNCIPIG

SEQ ID NO: 2682 - protein, 40 aa, Homo Sapiens
  Testis
  SIGNAL -24..-1: Von Heijne matrix
  score 9.20
  seq ICCVIVLISLSWT/SP
  UNSURE -22: Xaa = Cys,Phe
  UNSURE -16: Xaa = Phe,Val
MLXISLEIXSFICCVIVLISLSWTSPFTGVYLIGLIIEPG

SEQ ID NO: 2683 - protein, 28 aa, Homo Sapiens [sequence omitted]

SEQ ID NO: 2684 - protein, 51 aa, Homo Sapiens [sequence omitted]

SEQ ID NO: 2685 - protein, 76 aa, Homo Sapiens
  Spleen
  SIGNAL -19..-1: Von Heijne matrix; score 9.10; seq FLTLITHCTVSWA/QS
MAWSPLFLTLITHCTVSWAQSVLTQPPSVSEAPRQRVTISCFGSSSNIGRNAVNWYQQLPGRSPRLLIFYNNLPAS

SEQ ID NO: 2686 - protein, 21 aa, Homo Sapiens
  Testis
  SIGNAL -18..-1: Von Heijne matrix; score 9.10; seq LVSLCSWSPPLTS/SP
MLKSVLVSLCSWSPPLTSSPR

SEQ ID NO: 2687 - protein, 44 aa, Homo Sapiens
  Testis
  SIGNAL -22..-1: Von Heijne matrix
  score 9.00
  seq FILAALSLSTTFS/LQ
  UNSURE -18: Xaa = Phe,Leu
MTSKXILVSFILAALSLSTTFSLQPYQQKVLLVSFDGFRWDYLY

SEQ ID NO: 2688 - protein, 24 aa, Homo Sapiens
  Ovary
  SIGNAL -20..-1: Von Heijne matrix
  score 8.90
  seq LAVXLGLATAVSA/GP
  UNSURE -10: Xaa = Ala,Asp
  UNSURE -14: Xaa = Ile,Leu
MKSLSLXLAVXLGLATAVSAGPAW

SEQ ID NO: 2689 - protein, 80 aa, Homo Sapiens
  Ovary
  SIGNAL -21..-1: Von Heijne matrix; score 8.80; seq LLWALLFMQSLWP/QL
MWAMESGHLLWALLFMQSLWPQLTDGATRVYYLGIRDVQWNYAPKGRNVITNQPLDSDIVASSFLKSDKNRIGGTTRRPW

SEQ ID NO: 2690 - protein, 49 aa, Homo Sapiens
  Testis
  SIGNAL -20..-1: Von Heijne matrix
  score 8.80
  seq LLVMGSLPSASWS/LP
  UNSURE -14: Xaa = Phe,Leu
MAQTWAXLLVMGSLPSASWSLPCLSWESLLKAAACSELDGRNVGNTPTR

SEQ ID NO: 2691 - protein, 24 aa, Homo Sapiens [sequence omitted]

SEQ ID NO: 2692 - protein, 36 aa, Homo Sapiens
  Testis
  SIGNAL -25..-1: Von Heijne matrix; score 8.50; seq LKVLLLPLAPAAA/QD
MRKPAAGFLPSLLKVLLLPLAPAAAQDSTQASTPGR

SEQ ID NO: 2693 - protein, 54 aa, Homo Sapiens
  Spleen
  SIGNAL -17..-1: Von Heijne matrix
  score 8.40
  seq LLFLTSVVPFVLA/PR
  UNSURE 37: Xaa = Pro,Arg
MRQSLLFLTSVVPFVLAPRPPDDPGFGPHQRLEKLDSLLSDYDILSLSNIQQQX

SEQ ID NO: 2694 - protein, 38 aa, Homo Sapiens
  Ovary
  SIGNAL -25..-1: Von Heijne matrix; score 8.10; seq SVLLGLLALMATA/AV
MELSQMSELMGLSVLLGLLALMATAAVARGWLRAGEVR

SEQ ID NO: 2695 - protein, 103 aa, Homo Sapiens
  Testis
  SIGNAL -65..-1: Von Heijne matrix
  score 8.00
  seq LTLIGCLVTGVES/KI
  UNSURE 20: Xaa = Leu,Pro
  UNSURE 27: Xaa = Lys,Asn
MQDAPLSCLSPTKWSSVSSADSTEKSASAAGTRNLPFQFCLRQALRMKAAGILTLIGCLVTGVESKIYTRCKLAKIFSRAGLDNXRGFSLGXWICMAYYESGW

SEQ ID NO: 2696 - protein, 132 aa, Homo Sapiens
  Spleen
  SIGNAL -96..-1: Von Heijne matrix; score 7.60; seq ALCGLCLLCPRAA/RV
MALAFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWF

SEQ ID NO: 2697 - protein, 100 aa, Homo Sapiens
  Spleen
  SIGNAL -57..-1: Von Heijne matrix
  score 7.50
  seq LLHRLASFHRVWS/FP
  UNSURE -22: Xaa = Ala,Gly
  UNSURE -42: Xaa = Asp,Glu
  UNSURE 9: Xaa = Ile,Lys,Met,Asn
  UNSURE -24: Xaa = Leu,Arg
  UNSURE -27: Xaa = Lys,Asn
  UNSURE -44: Xaa = Met,Val
  UNSURE -33: Xaa = Phe,Tyr
  UNSURE -47: Xaa = Phe,Val
MLRFPTCFPSXRVXGXKQLPQEIIXLVWSPXRDXIXLANTAGEVLLHRLASFHRVWSFPPNENTGXEVTCLAWRPDGKLLAFALADTKKIVLCDVEKPES

SEQ ID NO: 2698 - protein, 130 aa, Homo Sapiens
  Spleen
  SIGNAL -42..-1: Von Heijne matrix
  score 7.50
  seq LALVVALVAERFA/RR
  UNSURE 56: Xaa = His,Leu,Pro,Arg
  UNSURE 62: Xaa = Pro,Arg
MFMVLEVVVSRVTSSLAMLSDSFHMLSDVLALVVALVAERFARRTHATQKNTFGWIRAEVMGALVNAIFLTGLCFAILLEAIERFIEPHEMQQPLVVXWGRAWXAAGQRAGALPLPPSQRLQPGLRPRPW

SEQ ID NO: 2699 - protein, 79 aa, Homo Sapiens
  Testis
  SIGNAL -39..-1: Von Heijne matrix; score 7.50; seq LLLLLGLIVLVNI/GI
MENQLWHNTVRCCNQYQESPHDAEDILLLLLGLIVLVNIGINVATMMWHGLQNALDKMIDWATQKIAVFFAVFVAAAAR

SEQ ID NO: 2700 - protein, 52 aa, Homo Sapiens
  Ovary
  SIGNAL -18..-1: Von Heijne matrix
  score 7.50
  seq ITLLTLSPNSVCC/CP
  UNSURE -15: Xaa = Ile,Arg,Ser
MLSXKITLLTLSPNSVCCCPSATLGASNHSHLWRSTSRHGISFPWAFLLING

SEQ ID NO: 2701 - protein, 52 aa, Homo Sapiens
  Testis
  SIGNAL -18..-1: Von Heijne matrix
  score 7.40
  seq GWLVLCVLAISLA/SM
  UNSURE 20: Xaa = Lys,Arg,Thr
MEGPRGWLVLCVLAISLASMVTEDLCRAPDGKKGEAGXPGRRGRPGLKGEQR

SEQ ID NO: 2702 - protein, 108 aa, Homo Sapiens
  Testis
  SIGNAL -20..-1: Von Heijne matrix; score 7.30; seq LAVFMLLAQLVSG/NW
MKSLLFTLAVFMLLAQLVSGNWYVKKCLNDVGICKKKCKPEEMHVKNGWAMCGKQRDCCVPADRRANYPVFCVQTKTTRISTVTATTATTTLMMTTASMSSMAPTRFS

SEQ ID NO: 2703 - protein, 18 aa, Homo Sapiens
  Ovary
  SIGNAL -16..-1: Von Heijne matrix; score 7.30; seq LILLFSLLISIVC/MI
MLKLILLFSLLISIVCMI

SEQ ID NO: 2704 - protein, 34 aa, Homo Sapiens
  Testis
  SIGNAL -26..-1: Von Heijne matrix; score 7.10; seq LASLQWSLTLAWC/GS
MTPWCLACLGRRPLASLQWSLTLAWCGSGSHWTE

SEQ ID NO: 2705 - protein, 55 aa, Homo Sapiens
  Spleen
  SIGNAL -26..-1: Von Heijne matrix; score 6.90; seq LWVLLLCAHVVTL/LV
MTMRHNWTPDLSPLWVLLLCAHVVTLLVRATPVSQTTTAATASVRSTKDPCPSQR

SEQ ID NO: 2706 - protein, 35 aa, Homo Sapiens [sequence omitted]

SEQ ID NO: 2707 - protein, 37 aa, Homo Sapiens
  Ovary
  SIGNAL -26..-1: Von Heijne matrix; score 6.90; seq LWVLLLCAHVVTL/LV
MTMRHNWTPDLSPLWVLLLCAHVVTLLVRATPVSQPT

SEQ ID NO: 2708 - protein, 85 aa, Homo Sapiens
  Testis
  SIGNAL -20..-1: Von Heijne matrix; score 6.90; seq LYLLGMLVPGGLG/YD
MKPLLETLYLLGMLVPGGLGYDRSLAQHRQEIVDKSVSPWSLETYSYNIYHPMGEIYEWMREISEKYKEVVTQHFLGVTYETQPA

SEQ ID NO: 2709 - protein, 72 aa, Homo Sapiens
  Spleen
  SIGNAL -65..-1: Von Heijne matrix; score 6.80; seq LLFLISLAAHLSQ/WT
MNQADPRLRAVCLWTLTSAAMSRGDNCTDLLALGIPSITQAWGLWVLLGAVTLLFLISLAAHLSQWTRGRSG

SEQ ID NO: 2710 - protein, 45 aa, Homo Sapiens [sequence omitted]

SEQ ID NO: 2711 - protein, 52 aa, Homo Sapiens
  Testis
  SIGNAL -43..-1: Von Heijne matrix
  score 6.80
  seq ALSAXTFVSFLHA/AP
  UNSURE -9: Xaa = Ala,Pro
MKQWLCWVLRLEGRQGLGVGEPRGLRLCLGALSAXTFVSFLHAAPHSHPALG

SEQ ID NO: 2712 - protein, 69 aa, Homo Sapiens [sequence omitted]

SEQ ID NO: 2713 - protein, 108 aa, Homo Sapiens [sequence omitted]

SEQ ID NO: 2714 - protein, 97 aa, Homo Sapiens
  Testis
  SIGNAL -27..-1: Von Heijne matrix; score 6.50; seq SLSLSTVWNWIQA/SF
MSTSSSSSWDNLLESLSLSTVWNWIQASFLGETSAPQQTSLGLLDNLAPAVQIILRISFLILLGIGIYALWKRSIQSIQKTLLFVITLYKLYKKGSA

SEQ ID NO: 2715 - protein, 92 aa, Homo Sapiens
  Spleen
  SIGNAL -26..-1: Von Heijne matrix
  score 6.50
  seq LALGSAGLLWCLA/GF
  UNSURE 41: Xaa = Asp,Asn
MVFATIGFSLKSGLALGSAGLLWCLAGFFGYDTQQPTAPNAIEGYRVMSSFGVGALFAACTICLLAXKLNKQTTLKMADDLAQRRQQADLAP

SEQ ID NO: 2716 - protein, 39 aa, Homo Sapiens
  Testis
  SIGNAL -14..-1: Von Heijne matrix; score 6.40; seq VLLLSGSVSVGVC/CA
MVLLLSGSVSVGVCCAYLCISISKTPTACALYGLYLPFF

SEQ ID NO: 2717 - protein, 48 aa, Homo Sapiens
  Uterus
  SIGNAL -29..-1: Von Heijne matrix
  score 6.40
  seq GLCXLCXVXNVFA/GS
  UNSURE -5: Xaa = Asn,Thr
  UNSURE -10: Xaa = Lys,Arg
  UNSURE -7: Xaa = Phe,Leu
MCSQKRAVSNQGLMDLGLCXLCXVXNVFAGSMPGKSHCHSPFSINQGR

SEQ ID NO: 2718 - protein, 43 aa, Homo Sapiens [sequence omitted]

SEQ ID NO: 2719 - protein, 124 aa, Homo Sapiens
  Testis
  SIGNAL -62..-1: Von Heijne matrix; score 6.40; seq SVLWLGALGLTIQ/AV
MTRLCLPRPEAREDPIPVPPRGLGAGEGSGSPVRPPVSTWGPSWAQLLDSVLWLGALGLTIQAVFSTTGPALLLLLVSFLTFDLLHRPAVTLCHSANFSPGARVRGPVKVLDSRRLYSCKWVQS

SEQ ID NO: 2720 - protein, 35 aa, Homo Sapiens
  Uterus
  SIGNAL -15..-1: Von Heijne matrix; score 6.40; seq LTCLFLSLISTYP/SC
MVLTCLFLSLISTYPSCITLFLSKIPNPLSSLPSL

SEQ ID NO: 2721 - protein, 37 aa, Homo Sapiens
  Testis
  SIGNAL -18..-1: Von Heijne matrix
  score 6.30
  seq FSFSLQLLSSSST/NP
  UNSURE 16: Xaa = Leu,Val
MLIPVFSFSLQLLSSSSTNPVNSTFQMPFESSHXTTR

SEQ ID NO: 2722 - protein, 64 aa, Homo Sapiens
  Spleen
  SIGNAL -47..-1: Von Heijne matrix
  score 6.30
  seq LLLLESVSGLLQP/RT
  UNSURE -43: Xaa = Cys,Phe,Ser,Tyr
MAAAXLSGPSAGSAAGVPGGTGGLSAVSSGPRLRLLLLESVSGLLQPRTGSAVAPVHPPNRSAR

SEQ ID NO: 2723 - protein, 21 aa, Homo Sapiens
  Ovary
  SIGNAL -15..-1: Von Heijne matrix; score 6.20; seq NWLFLFVFTFCNC/FF
MHNWLFLFVFTFCNCFFKNNG

SEQ ID NO: 2724 - protein, 36 aa, Homo Sapiens [sequence omitted]

SEQ ID NO: 2725 - protein, 59 aa, Homo Sapiens
  Ovary
  SIGNAL -19..-1: Von Heijne matrix; score 6.10; seq LALLWSLPASDLG/RS
MSPGSALALLWSLPASDLGRSVIAGLWPHTGVLIHLETSQSFLQGQLTKSIFPLCCTSL

SEQ ID NO: 2726 - protein, 37 aa, Homo Sapiens [sequence omitted]

SEQ ID NO: 2727 - protein, 26 aa, Homo Sapiens
  Ovary
  SIGNAL -16..-1: Von Heijne matrix; score 6.10; seq FLFCTLFSLVVHP/SH
MLAFLFCTLFSLVVHPSHIDLKCSFY

SEQ ID NO: 2728 - protein, 106 aa, Homo Sapiens
  Spleen
  SIGNAL -36..-1: Von Heijne matrix
  score 6.00
  seq LLYTLQTISSLSG/CF
  UNSURE 46: Xaa =  * ,Leu
  UNSURE 56: Xaa =  * ,Lys
  UNSURE 59: Xaa = Gly,Arg
  UNSURE 45: Xaa = Leu,Pro
  UNSURE 52: Xaa = Phe,Leu
  UNSURE 55,57,60: Xaa = Pro,Ser
MAQMPLTGSYQDLEYFLECMFLHLLYTLQTISSLSGCFKQFFFQLNCFCWGEILWHSSFLHSGSCLLVLLIKKKKIYLQSXXIYTGYXIDXXXLXXFSIPLSFIQF

SEQ ID NO: 2729 - protein, 20 aa, Homo Sapiens [sequence omitted]

SEQ ID NO: 2730 - protein, 27 aa, Homo Sapiens
  Uterus
  SIGNAL -19..-1: Von Heijne matrix
  score 6.00
  seq LAILIXSLKLTIG/IQ
  UNSURE -8: Xaa = Phe,Val
MINHLYLAILIXSLKLTIGIQKRFGPP

SEQ ID NO: 2731 - protein, 69 aa, Homo Sapiens [sequence omitted]

SEQ ID NO: 2732 - protein, 74 aa, Homo Sapiens
  Testis
  SIGNAL -39..-1: Von Heijne matrix; score 5.90; seq SAWWCVLLEWSQG/AS
MELTNKQTGTDRHEQVLRRVKQDKRISAWWCVLLEWSQGASLRRQHRGETSPKSGERLSRQREQQKPQMSDKSL

SEQ ID NO: 2733 - protein, 70 aa, Homo Sapiens
  Testis
  SIGNAL -22..-1: Von Heijne matrix
  score 5.90
  seq VLGLLFSISDTWA/PA
  UNSURE 21: Xaa =  * ,Ile,Lys,Leu
  UNSURE 22: Xaa =  * ,Lys
  UNSURE 28: Xaa = Asp,Glu
MAKRQNPTSVLGLLFSISDTWAPAVSSWKAEAKDGADQEDARXXSQRSPXSTAGSQEPYFWFVWVEGEGR

SEQ ID NO: 2734 - protein, 42 aa, Homo Sapiens
  Testis
  SIGNAL -25..-1: Von Heijne matrix
  score 5.90
  seq FCLSLQIFRVSLA/LA
  UNSURE 15: Xaa = Glu,Lys
  UNSURE 3: Xaa = His,Gln
MNVLPFSYYYILFCLSLQIFRVSLALAXTHEVPVSTHTNXLH

SEQ ID NO: 2735 - protein, 58 aa, Homo Sapiens
  Ovary
  SIGNAL -29..-1: Von Heijne matrix
  score 5.90
  seq FSYISXFLSPVCG/CS
  UNSURE -8: Xaa = Cys,Gly
  UNSURE 26: Xaa = Phe,Leu
MKCLKVNPFLFLVFNFFSYISXFLSPVCGCSVCNLKHWENELLFPSPHFLPYKFXFLF

SEQ ID NO: 2736 - protein, 51 aa, Homo Sapiens
  Testis
  SIGNAL -33..-1: Von Heijne matrix
  score 5.80
  seq XLCLGMALCPRQA/TR
  UNSURE -13: Xaa = Phe,Val
MSWTVPVVRASQRVSSVGANXLCLGMALCPRQATRIPLNGTWLFTPVSKMA

SEQ ID NO: 2737 - protein, 21 aa, Homo Sapiens
  Ovary
  SIGNAL -15..-1: Von Heijne matrix
  score 5.80
  seq FLXLMTLTTHVHS/SA
  UNSURE -11: Xaa = Cys,Ser
MGFLXLMTLTTHVHSSAKPNG

SEQ ID NO: 2738 - protein, 22 aa, Homo Sapiens
  Ovary
  SIGNAL -16..-1: Von Heijne matrix; score 5.70; seq RVLLLAQLFLGSG/KT
MLFRVLLLAQLFLGSGKTLRTP

SEQ ID NO: 2739 - protein, 55 aa, Homo Sapiens [sequence omitted]

SEQ ID NO: 2740 - protein, 40 aa, Homo Sapiens
  Ovary
  SIGNAL -31..-1: Von Heijne matrix
  score 5.70
  seq SDLCLCQCILARA/HD
  UNSURE -27: Xaa = Arg,Ser
MFPHXETQVKCFWQGLRRSDLCLCQCILARAHDGDLYLFF

SEQ ID NO: 2741 - protein, 64 aa, Homo Sapiens
  Testis
  SIGNAL -20..-1: Von Heijne matrix
  score 5.60
  seq LAVFMXLAQLVSG/NW
  UNSURE 10: Xaa = Ala,Asp,Glu,Gly,Val
  UNSURE 30: Xaa = Ala,Pro
  UNSURE -8: Xaa = Leu,Arg
  UNSURE 16: Xaa = Lys,Met,Arg,Thr
MKSLLFTLAVFMXLAQLVSGNWYVKKCLNXFGICKXKCKPEEMHVKNGWXMCGKQRDCCVPANG

SEQ ID NO: 2742 - protein, 48 aa, Homo Sapiens [sequence omitted]

SEQ ID NO: 2743 - protein, 21 aa, Homo Sapiens
  Testis
  SIGNAL -16..-1: Von Heijne matrix; score 5.50; seq PLVLSPLSYQCSS/QG
MRAPLVLSPLSYQCSSQGHIW

SEQ ID NO: 2744 - protein, 39 aa, Homo Sapiens
  Testis
  SIGNAL -36..-1: Von Heijne matrix
  score 5.50
  seq FTSMCILFHCLLS/FQ
  UNSURE -24: Xaa = Ile,Lys
MQVPHLRVWTQVXDTFIGYRNLGFTSMCILFHCLLSFQR

SEQ ID NO: 2745 - protein, 46 aa, Homo Sapiens
  Testis
  SIGNAL -36..-1: Von Heijne matrix; score 5.40; seq LWLMHQSFQKSNS/SS
MQKLMAVPMITRAQGGDTCTRQILWLMHQSFQKSNSSSTSYCSAQG

SEQ ID NO: 2746 - protein, 54 aa, Homo Sapiens
  Ovary
  SIGNAL -45..-1: Von Heijne matrix
  score 5.40
  seq AHRSLCLWPACLC/AR
  UNSURE -39: Xaa = Asn,Tyr
  UNSURE -43: Xaa = Ile,Val
  UNSURE -15: Xaa = Leu,Pro
MCXAGFXDHPRAARHARTSRHPLPWVCVSQXPAHRSLCLWPACLCARVLPPAPG

SEQ ID NO: 2747 - protein, 22 aa, Homo Sapiens
  Testis
  SIGNAL -18..-1: Von Heijne matrix; score 5.40; seq ILVSFILAALSLS/TT
MTSKFILVSFILAALSLSTTIG

SEQ ID NO: 2748 - protein, 18 aa, Homo Sapiens [sequence omitted]

SEQ ID NO: 2749 - protein, 20 aa, Homo Sapiens
  Ovary
  SIGNAL -16..-1: Von Heijne matrix; score 5.30; seq SSLMVQLISQVYS/CM
MLSSSLMVQLISQVYSCMRR

SEQ ID NO: 2750 - protein, 30 aa, Homo Sapiens
  Testis
  SIGNAL -14..-1: Von Heijne matrix; score 5.30; seq FSYILCMLFCLFS/QD
MFSYILCMLFCLFSQDKFLEVTLLCERYML

SEQ ID NO: 2751 - protein, 45 aa, Homo Sapiens
  Uterus
  SIGNAL -19..-1: Von Heijne matrix
  score 5.20
  seq VTLAFSLLVLSES/AV
  UNSURE 10: Xaa =  * ,Trp
MLFLYYVTLAFSLLVLSESAVLKRREIFXTGLGCVTGLGCVTGLR

SEQ ID NO: 2752 - protein, 31 aa, Homo Sapiens
  Spleen
  SIGNAL -14..-1: Von Heijne matrix; score 5.20; seq LLSGLWLSSVKEC/DD
MLLSGLWLSSVKECDDWRADGCLPSIVHPLR

SEQ ID NO: 2753 - protein, 41 aa, Homo Sapiens
  Testis
  SIGNAL -18..-1: Von Heijne matrix; score 5.20; seq VFCFSWLMSSSSP/SI
MVAFSVFCFSWLMSSSSPSIFWSHFYSPFKDLSKMYNYVSP

SEQ ID NO: 2754 - protein, 42 aa, Homo Sapiens [sequence omitted]

SEQ ID NO: 2755 - protein, 41 aa, Homo Sapiens [sequence omitted]

SEQ ID NO: 2756 - protein, 16 aa, Homo Sapiens
  Uterus
  SIGNAL -14..-1: Von Heijne matrix; score 5.10; seq SLAKSLFLRVARG/LG
MSLAKSLFLRVARGLG

SEQ ID NO: 2757 - protein, 94 aa, Homo Sapiens [sequence omitted]

SEQ ID NO: 2758 - protein, 51 aa, Homo Sapiens [sequence omitted]

SEQ ID NO: 2759 - protein, 79 aa, Homo Sapiens
  Ovary
  SIGNAL -41..-1: Von Heijne matrix
  score 5.00
  seq FCFFPAFLVXVXS/QP
  UNSURE -2: Xaa = Phe,Leu
  UNSURE -4: Xaa = Ser,Thr
MTPLGSGPPREASIAQVRGFSRTFFRVAFCFFPAFLVXVXSQPSGFSTTETLCAQDFSDVIFLRRADTRRWKKKQLRRR

SEQ ID NO: 2760 - protein, 50 aa, Homo Sapiens
  Testis
  SIGNAL -15..-1: Von Heijne matrix
  score 5.00
  seq CSALFPLLSLLSC/KE
  UNSURE 16: Xaa = Gly,Arg,Trp
  UNSURE 4: Xaa = Ile,Met
MRCSALFPLLSLLSCKERXWCLSTLEDAATXRHLGSREQPSGDAEPVEVW

SEQ ID NO: 2761 - protein, 35 aa, Homo Sapiens
  Ovary
  SIGNAL -21..-1: Von Heijne matrix; score 5.00; seq IISLLKLCSFCFI/KD
MLYDQYYLIISLLKLCSFCFIKDFKASNITLVVIL

SEQ ID NO: 2762 - protein, 75 aa, Homo Sapiens [sequence omitted]

SEQ ID NO: 2763 - protein, 93 aa, Homo Sapiens
  Testis
  SIGNAL -18..-1: Von Heijne matrix; score 5.00; seq LTYLLFLPDWAAV/FE
MHGAGLTYLLFLPDWAAVFELYNCEDERCYLDLARLRGVHYITWRRQNKVFPQDKGHHPTLGEHPKFTNYSFDVEEFMYLVLQAADHVLQHPG

SEQ ID NO: 2764 - protein, 41 aa, Homo Sapiens [sequence omitted]

SEQ ID NO: 2765 - protein, 45 aa, Homo Sapiens
  Ovary
  SIGNAL -39..-1: Von Heijne matrix; score 4.90; seq SGLRGLLLQEALG/AV
MAELDLMAPGPLPRATAQPPAPLSPDSGLRGLLLQEALGAVPDPR

SEQ ID NO: 2766 - protein, 56 aa, Homo Sapiens
  Ovary
  SIGNAL -28..-1: Von Heijne matrix
  score 4.90
  seq FLVACPLFGVCLX/FF
  UNSURE -1: Xaa = Ile,Lys,Met
MTLTHGNNILHLANFFLVACPLFGVCLXFFILRFRLYIQGPNVTQVILHLSQGTLS

SEQ ID NO: 2767 - protein, 16 aa, Homo Sapiens
  Ovary
  SIGNAL -14..-1: Von Heijne matrix; score 4.90; seq VLRWLPWPRGSHS/DS
MVLRWLPWPRGSHSDS

SEQ ID NO: 2768 - protein, 39 aa, Homo Sapiens
  Uterus
  SIGNAL -24..-1: Von Heijne matrix; score 4.80; seq FSFLGTLFHKSNS/ED
MKARLSGNLICFSFLGTLFHKSNSEDSSVGKGDWKKKNK

SEQ ID NO: 2769 - protein, 37 aa, Homo Sapiens
  Ovary
  SIGNAL -16..-1: Von Heijne matrix; score 4.80; seq VCLVPQTPSLCLG/KG
MSHVCLVPQTPSLCLGKGTPRSRSAPFQSSGPHRLCA

SEQ ID NO: 2770 - protein, 68 aa, Homo Sapiens
  Spleen
  SIGNAL -29..-1: Von Heijne matrix; score 4.80; seq VLTSVNLFIGING/SV
MYPASFVFKIPSTAYVVLTSVNLFIGINGSVATFVLELFTDNKLNNINDILKSVFLIFPHFCLGRGQT

SEQ ID NO: 2771 - protein, 42 aa, Homo Sapiens
  Testis
  SIGNAL -30..-1: Von Heijne matrix
  score 4.80
  seq RSSLWVTAPLVSA/CP
  UNSURE -19: Xaa = Arg,Thr
MSSSRKDHLGAXAQSPSRSSLWVTAPLVSACPTCSPATHPTG

SEQ ID NO: 2772 - protein, 56 aa, Homo Sapiens
  Spleen
  SIGNAL -19..-1: Von Heijne matrix
  score 4.80
  seq ATYLVQSSACCPA/IV
  UNSURE 20: Xaa = Asp,Glu
  UNSURE 8: Xaa = Leu,Ser,Trp
MASPAAATYLVQSSACCPAIVRHLCQXYRSMPVFLDPAXIATLEGISWRLPSAPSD

SEQ ID NO: 2773 - protein, 69 aa, Homo Sapiens
  Testis
  SIGNAL -61..-1: Von Heijne matrix
  score 4.70
  seq LLPCNLHXSWLHS/SP
  UNSURE -17: Xaa =  * ,Ala,Glu,Lys,Pro,Gln,Ser,Thr
  UNSURE -6: Xaa =  * ,Cys
MNAAINTGPAPAVTKTETEVQNPDVLWDLDIPEARSHADQDSNPXAEALLPCNLHXSWLHSSPRPDPHS

SEQ ID NO: 2774 - protein, 61 aa, Homo Sapiens
  Testis
  SIGNAL -43..-1: Von Heijne matrix
  score 4.70
  seq GIFLVIFCSESFS/LL
  UNSURE -20: Xaa = Cys,Phe,Leu,Trp
MINLLVGNCIYLLGAIRASCMCRXMSFAKFGIFLVIFCSESFSLLLWNFSSIYVKTFWPVG

SEQ ID NO: 2775 - protein, 52 aa, Homo Sapiens [sequence omitted]

SEQ ID NO: 2776 - protein, 26 aa, Homo Sapiens
  Spleen
  SIGNAL -19..-1: Von Heijne matrix; score 4.70; seq ILLRMTVLPTLWT/RR
MRKTSFILLRMTVLPTLWTRRRVQLV

SEQ ID NO: 2777 - protein, 41 aa, Homo Sapiens
  Ovary
  SIGNAL -23..-1: Von Heijne matrix
  score 4.60
  seq VRVGLVLVXRALC/LX
  UNSURE -5: Xaa =  * ,Ser
  UNSURE 10: Xaa = Arg,Thr
  UNSURE 2: Xaa = Cys,Phe
MWWKPAPEEGVRVGLVLVXRALCLXVLSRFMFXNPGLGGMG

SEQ ID NO: 2778 - protein, 27 aa, Homo Sapiens [sequence omitted]

SEQ ID NO: 2779 - protein, 119 aa, Homo Sapiens
  Testis
  SIGNAL -42..-1: Von Heijne matrix
  score 4.60
  seq LDPAVSLSAPAFA/SA
  UNSURE 55,61: Xaa =  * ,Cys
  UNSURE 52: Xaa = Arg,Ser
  UNSURE 54: Xaa = His,Leu
  UNSURE 56,65: Xaa = Ile,Leu
  UNSURE 67: Xaa = Leu,Met
  UNSURE 50: Xaa = Lys,Asn,Thr
  UNSURE 68: Xaa = Pro,Thr
MKRGAFSNLNDSQLSASFLQPSLQANCPALDPAVSLSAPAFASALRSMKSSQAARKDDFLRSLSDGDSGTSEHISAVVTSPRISCHGAAIPXAXAXXXGCSCXTERXLXXPPSLLSLEA

SEQ ID NO: 2780 - protein, 80 aa, Homo Sapiens
  Testis
  SIGNAL -24..-1: Von Heijne matrix; score 4.60; seq FFIFCSLNTLLLG/GV
MKSAKLGFLLRFFIFCSLNTLLLGGVNKIAEKICGDLKDPCKLDMNFGSCYEVHFRYFYNRTSKRCETFVFSSCNGNLNG

SEQ ID NO: 2781 - protein, 40 aa, Homo Sapiens
  Testis
  SIGNAL -15..-1: Von Heijne matrix
  score 4.60
  seq ILFPLHSVIGSHP/QC
  UNSURE 7: Xaa = Arg,Trp
MDILFPLHSVIGSHPQCLPERXTARMIKLKWGNGSGSDFG

SEQ ID NO: 2782 - protein, 52 aa, Homo Sapiens
  Testis
  SIGNAL -27..-1: Von Heijne matrix
  score 4.60
  seq FGILILLSQRQWS/KN
  UNSURE -20: Xaa =  * ,Cys
MLKVFRAXHPKICHFGILILLSQRQWSKNRCREGCLTTLFLFEAEHKSSLVK

SEQ ID NO: 2783 - protein, 45 aa, Homo Sapiens
  Uterus
  SIGNAL -34..-1: Von Heijne matrix
  score 4.60
  seq LXWRKLAASWTLS/QE
  UNSURE -12: Xaa = Ile,Val
MLVRNARRGSRGRSPWWRAGCLXWRKLAASWTLSQEIFRGSRKGS

SEQ ID NO: 2784 - protein, 52 aa, Homo Sapiens [sequence omitted]

SEQ ID NO: 2785 - protein, 25 aa, Homo Sapiens
  Spleen
  SIGNAL -23..-1: Von Heijne matrix
  score 4.50
  seq RLHILFIVCLARG/KG
  UNSURE -19: Xaa = Cys,Asp,Gly,Tyr
MTYHXIQFSERLHILFIVCLARGKG

SEQ ID NO: 2786 - protein, 74 aa, Homo Sapiens [sequence omitted]

SEQ ID NO: 2787 - protein, 140 aa, Homo Sapiens
  Testis
  SIGNAL -25..-1: Von Heijne matrix
  score 4.40
  seq AMGFLLMFDLTSQ/QS
  UNSURE 79: Xaa =  * ,Glu,Gly,Lys,Gln,Arg,Trp
MFRSLTTAFFRDAMGFLLMFDLTSQQSFLNVRNWMSQLQANAYCENPDIVLIGNKADLPDQREVNERQARELADKYGIPYFETSAATGQNVEKAVETLLDLIMXRMEQCVEKTQIPDTVNGGNSGNLDGESHQRRNVSAR

SEQ ID NO: 2788 - protein, 45 aa, Homo Sapiens
  Testis
  SIGNAL -37..-1: Von Heijne matrix
  score 4.40
  seq LSYASSALSPCLX/AP
  UNSURE -1: Xaa = Ile,Asn,Thr
MVLTTLPLPSANSPVNMPTTGPNSLSYASSALSPCLXAPKSPRLG

SEQ ID NO: 2789 - protein, 55 aa, Homo Sapiens
  Testis
  SIGNAL -30..-1: Von Heijne matrix
  score 4.30
  seq LLPTLPWLPSTRL/LS
  UNSURE 15: Xaa = Ala,Ser,Thr
MQRNATFIHLQLAIRPSLLPTLPWLPSTRLLSPTPLGQLRGPPGXQRAMPTAHLR

SEQ ID NO: 2790 - protein, 20 aa, Homo Sapiens
  Ovary
  SIGNAL -15..-1: Von Heijne matrix; score 4.30; seq ILFCFHSFHPLFQ/DT
MNILFCFHSFHPLFQDTIEF

SEQ ID NO: 2791 - protein, 58 aa, Homo Sapiens [sequence omitted]

SEQ ID NO: 2792 - protein, 58 aa, Homo Sapiens
  Testis
  SIGNAL -26..-1: Von Heijne matrix; score 4.30; seq ALCRFVGMQPCTA/QT
MKLNPGQVPTWWEALCRFVGMQPCTAQTGLLPHGTHNTRERQRDPSAQKNTRRFSPVG

SEQ ID NO: 2793 - protein, 30 aa, Homo Sapiens
  Spleen
  SIGNAL -27..-1: Von Heijne matrix; score 4.30; seq LCLNLCPCSSSLL/SP
MLAGFRRSAPASQSLCLNLCPCSSSLLSPA

SEQ ID NO: 2794 - protein, 25 aa, Homo Sapiens [sequence omitted]

SEQ ID NO: 2795 - protein, 32 aa, Homo Sapiens [sequence omitted]

SEQ ID NO: 2796 - protein, 34 aa, Homo Sapiens
  Testis
  SIGNAL -21..-1: Von Heijne matrix
  score 4.20
  seq VLSIAASLLQCRL/AV
  UNSURE 12: Xaa = Ala,Asp,Gly,His,Ile,Leu,Asn,Pro,Arg,Ser,Thr,Val
MQLCPFTSVLSIAASLLQCRLAVVTETIWPPQXW

SEQ ID NO: 2797 - protein, 72 aa, Homo Sapiens
  Testis
  SIGNAL -44..-1: Von Heijne matrix
  score 4.20
  seq QLLFKLNSTWCRA/LQ
  UNSURE 20: Xaa = Met,Thr
MDVTCCFDAVEGSDFRVCCHGCVSWLCLQMLQLLFKLNSTWCRALQSETSLASRRLWMWVSHLXEFFTVTPW

SEQ ID NO: 2798 - protein, 26 aa, Homo Sapiens
  Ovary
  SIGNAL -22..-1: Von Heijne matrix; score 4.20; seq HCFCFTLFSYSSS/FF
MRQGPGAPLHCFCFTLFSYSSSFFFF

SEQ ID NO: 2799 - protein, 23 aa, Homo Sapiens
  Testis
  SIGNAL -15..-1: Von Heijne matrix
  score 4.20
  seq ITLLGIWLTXRLQ/FP
  UNSURE -4: Xaa = Cys,Gly
MHITLLGIWLTXRLQFPRSGRAG

SEQ ID NO: 2800 - protein, 24 aa, Homo Sapiens [sequence omitted]

SEQ ID NO: 2801 - protein, 50 aa, Homo Sapiens
  Uterus
  SIGNAL -32..-1: Von Heijne matrix
  score 4.20
  seq XXXXFLLGRRVVG/ES
  UNSURE -10: Xaa = Ala,Leu,Pro,Val
  UNSURE -13: Xaa = Gly,Val
  UNSURE 3: Xaa = His,Leu,Pro,Arg
  UNSURE -11: Xaa = Leu,Met
  UNSURE -12: Xaa = Leu,Val
MLFFPLLSFRFLPSESLLKXXXXFLLGRRVVGESXFIFTCGNLLLIWPYG

SEQ ID NO: 2802 - protein, 25 aa, Homo Sapiens [sequence omitted]

SEQ ID NO: 2803 - protein, 40 aa, Homo Sapiens
  Ovary
  SIGNAL -38..-1: Von Heijne matrix; score 4.10; seq GILCGSLPGPSLC/PP
MGMSGKKHFPLSWDHIQGSTEATSQGILCGSLPGPSLCPP

SEQ ID NO: 2804 - protein, 74 aa, Homo Sapiens
  Testis
  SIGNAL -37..-1: Von Heijne matrix
  score 4.00
  seq PLSLDCGHSLCRA/CI
  UNSURE 26: Xaa = Asp,Tyr
  UNSURE 28: Xaa = Phe,Val
MASKILLNVQEEVTCPICLELLTEPLSLDCGHSLCRACITVSNKEAVTSMGGKSSCPVCGISXSXEHLQANQHR

SEQ ID NO: 2805 - protein, 31 aa, Homo Sapiens
  Testis
  SIGNAL -14..-1: Von Heijne matrix; score 4.00; seq YYMVCLFFRLIFS/EH
MYYMVCLFFRLIFSEHLPIIGTVTSHKTGTG

SEQ ID NO: 2806 - protein, 48 aa, Homo Sapiens
  Ovary
  SIGNAL -36..-1: Von Heijne matrix
  score 4.00
  seq KLAGLWSPGLVPA/AP
  UNSURE -31: Xaa = Gly,Arg
MGAGGXREIRAAAASWLRAAEHSKLAGLWSPGLVPAAPRTENYTIGPL

SEQ ID NO: 2807 - protein, 80 aa, Homo Sapiens
  Testis
  SIGNAL -60..-1: Von Heijne matrix; score 4.00; seq LVRRTLLVAALRA/WM
MGSKCCKGGPDEDAVERQRRQKLLLAQLHHRKRVKAAGQIQAWWRGVLVRRTLLVAALRAWMIQCWWRTLVQRRIRQRRQ

SEQ ID NO: 2808 - protein, 30 aa, Homo Sapiens [sequence omitted]

SEQ ID NO: 2809 - protein, 58 aa, Homo Sapiens
  Ovary
  SIGNAL -49..-1: Von Heijne matrix
  score 4.00
  seq ATCCLSLFQWCAV/LR
  UNSURE -44: Xaa =  * ,Ser
  UNSURE -26: Xaa = Arg,Thr
  UNSURE -25: Xaa = Asp,Asn
MSRYEXGSSLLPFPDHFSVYSFKXXSFFEAYSISDYATCCLSLFQWCAVLRFLSLPLP

SEQ ID NO: 2810 - protein, 29 aa, Homo Sapiens
  Ovary
  SIGNAL -24..-1: Von Heijne matrix; score 3.90; seq LLLHHYLLLFITT/SR
MIYFIKINNKLLLLHHYLLLFITTSRPTG

SEQ ID NO: 2811 - protein, 34 aa, Homo Sapiens [sequence omitted]

SEQ ID NO: 2812 - protein, 41 aa, Homo Sapiens
  Ovary
  SIGNAL -14..-1: Von Heijne matrix
  score 3.90
  seq TLAVTLSALGATG/LF
  UNSURE 19: Xaa = Phe,Leu
MTLAVTLSALGATGLFKEACDLTFLNIGQITSXLKQSGGPQ

SEQ ID NO: 2813 - protein, 72 aa, Homo Sapiens
  Uterus
  SIGNAL -41..-1: Von Heijne matrix
  score 3.90
  seq CRCLITLPRSCRP/ST
  UNSURE 17: Xaa = Ala,Gly,Pro,Arg
  UNSURE 7: Xaa = Ala,Thr
MLGPPLQPGSHGKVLAPQGSSGLTPPFPCRCLITLPRSCRPSTSVPRXASTRSSQRPXSSCWRSSCSTTATM

SEQ ID NO: 2814 - protein, 48 aa, Homo Sapiens
  Testis
  SIGNAL -27..-1: Von Heijne matrix
  score 3.80
  seq QLXLILVHFPAYS/VE
  UNSURE -11: Xaa = Ala,Ser,Thr
MGNVCSCCLRARYQQLXLILVHFPAYSVEDQRVDPGVPGESTVCHHNR

SEQ ID NO: 2815 - protein, 41 aa, Homo Sapiens [sequence omitted]

SEQ ID NO: 2816 - protein, 79 aa, Homo Sapiens [sequence omitted]

SEQ ID NO: 2817 - protein, 19 aa, Homo Sapiens
  Ovary
  SIGNAL -13..-1: Von Heijne matrix; score 3.80; seq MLFLVLFYSAIFL/FT
MLFLVLFYSAIFLFTLTFF

SEQ ID NO: 2818 - protein, 16 aa, Homo Sapiens [sequence omitted]

SEQ ID NO: 2819 - protein, 22 aa, Homo Sapiens [sequence omitted]

SEQ ID NO: 2820 - protein, 40 aa, Homo Sapiens [sequence omitted]

SEQ ID NO: 2821 - protein, 31 aa, Homo Sapiens
  Ovary
  SIGNAL -14..-1: Von Heijne matrix
  score 3.70
  seq MLPLFCSPWESGG/RT
  UNSURE 11: Xaa =  * ,Leu
  UNSURE 9: Xaa = Pro,Ser
MMLPLFCSPWESGGRTVKQSEGXCXFQAPHG

SEQ ID NO: 2822 - protein, 38 aa, Homo Sapiens
  Uterus
  SIGNAL -15..-1: Von Heijne matrix; score 3.70; seq KLLSDLSVDSARC/KP
MAKLLSDLSVDSARCKPGNNLTKSLLNIHDKQLQHDPR

SEQ ID NO: 2823 - protein, 73 aa, Homo Sapiens
  Testis
  SIGNAL -18..-1: Von Heijne matrix
  score 3.70
  seq VCWGHLLPARVST/RS
  UNSURE 54: Xaa = His,Gln
MCGYWVCWGHLLPARVSTRSSEQPRVTPRDEDAMMSASLLTWRYVTFMVPMPLSPCRSVWVCFRQKILEYVXA

SEQ ID NO: 2824 - protein, 34 aa, Homo Sapiens
  Uterus
  SIGNAL -24..-1: Von Heijne matrix; score 3.70; seq AILGLSTFLNLLS/IN
MKLSCAGCADTAILGLSTFLNLLSINLLGMISFS

SEQ ID NO: 2825 - protein, 58 aa, Homo Sapiens
  Spleen
  SIGNAL -21..-1: Von Heijne matrix
  score 3.70
  seq FSLGSCPAGPLSA/CV
  UNSURE 20: Xaa =  * ,Gly
  UNSURE 23: Xaa = Lys,Asn,Arg,Ser
MIPFSGTVFSLGSCPAGPLSACVPDHGSLQYPLTIYQQDCXTHXCPRCLSLPLQHPRQ

SEQ ID NO: 2826 - protein, 97 aa, Homo Sapiens
  Testis
  SIGNAL -35..-1: Von Heijne matrix
  score 3.70
  seq PAVSLSAPAFASA/LR
  UNSURE -26: Xaa =  * ,Cys
  UNSURE -15: Xaa = Arg,Trp
  UNSURE 55: Xaa = Cys,Arg
  UNSURE 5: Xaa = Lys,Thr
MIPSSQPRFXNPACKQTVLLXDPAVSLSAPAFASALRSMXSSQAARKDDFLRSLSDGDSGTSEHISAVVTSPRISCHGAAIPTARALCLXCSCCTER

SEQ ID NO: 2827 - protein, 22 aa, Homo Sapiens
  Ovary
  SIGNAL -15..-1: Von Heijne matrix; score 3.60; seq PTFLLISDSFLTS/QP
MAPTFLLISDSFLTSQPSFFFF

SEQ ID NO: 2828 - protein, 48 aa, Homo Sapiens [sequence omitted]

SEQ ID NO: 2829 - protein, 45 aa, Homo Sapiens
  Ovary
  SIGNAL -43..-1: Von Heijne matrix
  score 3.60
  seq LLYFNTFLPRKVA/RV
  UNSURE -25: Xaa = Glu,Gly
MACDSFLKDALPQELSQLXFLFPLVDMREDLLYFNTFLPRKVARV

SEQ ID NO: 2830 - protein, 68 aa, Homo Sapiens [sequence omitted]

SEQ ID NO: 2831 - protein, 40 aa, Homo Sapiens
  Spleen
  SIGNAL -26..-1: Von Heijne matrix
  score 3.50
  seq LLPFTFLSLKAFL/QX
  UNSURE 2: Xaa = Leu,Pro,Ser
MISKYVHYSLTDLLLPFTFLSLKAFLQXRVLMSLPQHKPW

SEQ ID NO: 2832 - protein, 51 aa, Homo Sapiens [sequence omitted]

SEQ ID NO: 2833 - protein, 29 aa, Homo Sapiens
  Testis
  SIGNAL -15..-1: Von Heijne matrix
  score 3.50
  seq LCFLLPHHRLQEA/RX
  UNSURE 2: Xaa =  * ,Gln
  UNSURE 8: Xaa = Ile,Met
MILCFLLPHHRLQEARXIQVLKXLPREKL

SEQ ID NO: 2834 - protein, 83 aa, Homo Sapiens [sequence omitted]

SEQ ID NO: 2835 - protein, 35 aa, Homo Sapiens
  Testis
  SIGNAL -31..-1: Von Heijne matrix; score 3.50; seq VLLNLALSHFNNC/GL
MEFAHAAECVSFALNETHVLLNLALSHFNNCGLAV

SEQ ID NO: 2836 - protein, 48 aa, Homo Sapiens [sequence omitted]

SEQ ID NO: 2837 - protein, 43 aa, Homo Sapiens [sequence omitted]

SEQ ID NO: 2838 - protein, 35 aa, Homo Sapiens
  Testis
  SIGNAL -21..-1: Von Heijne matrix; score 12.70; seq ILFLLSWSGPLQG/QQ
MGPSTPLLILFLLSWSGPLQGQQHHLVEYMERRHG

SEQ ID NO: 2839 - protein, 29 aa, Homo Sapiens
  Ovary
  SIGNAL -20..-1: Von Heijne matrix; score 7.40; seq LVFCVGLLTMAKA/ES
MASLGHILVFCVGLLTMAKAESPKEHDPR

SEQ ID NO: 2840 - protein, 47 aa, Homo Sapiens
  Testis
  SIGNAL -23..-1: Von Heijne matrix; score 7.30; seq ALSLLLVSGSLLP/GP
MSGSSLPSALALSLLLVSGSLLPGPGAAQNEPRIVTSEEVIIRDSPV

SEQ ID NO: 2841 - protein, 65 aa, Homo Sapiens
  Ovary
  SIGNAL -57..-1: Von Heijne matrix; score 7.10; seq VGLAVVSLGGSRG/SG
MMEVVVGNGVVALRGIPPRTSRKSSRKTRFCGERGSKQSGKCSPVGLAVVSLGGSRGSGKGLGRL

SEQ ID NO: 2842 - protein, 58 aa, Homo Sapiens
  Testis
  SIGNAL -16..-1: Von Heijne matrix
  score 6.70
  seq CFSLVLLLTSIWT/TR
  UNSURE 22: Xaa = Ile,Met
MARCFSLVLLLTSIWTTRLLVQGSLRAEELSIQVSCRXMGITLVSKKANQQLNFTEAK

SEQ ID NO: 2843 - protein, 136 aa, Homo Sapiens
  Spleen
  SIGNAL -21..-1: Von Heijne matrix; score 5.60; seq CLSCLLIPLALWS/II
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCRTLDGWEYAFEGTAG

SEQ ID NO: 2844 - protein, 82 aa, Homo Sapiens
  Uterus
  SIGNAL -21..-1: Von Heijne matrix; score 5.60; seq CLSCLLIPLALWS/II
MGSRKCGGCLSCLLIPLALWSIIVNILLYFPNGQTSYASSNKLTNYVWYFEGICFSGIMMLIVTTVLLVLENNNNYKCCQSG

SEQ ID NO: 2845 - protein, 24 aa, Homo Sapiens
  Testis
  SIGNAL -17..-1: Von Heijne matrix; score 5.30; seq ILFGVSFVFLTHC/TI
MMVMILFGVSFVFLTHCTIQSSCG

SEQ ID NO: 2846 - protein, 34 aa, Homo Sapiens
  Testis
  SIGNAL -19..-1: Von Heijne matrix
  score 4.40
  seq VLVSLPHPHPALT/CC
  UNSURE 6: Xaa = His,Leu
MSNTHTVLVSLPHPHPALTCCHLGXPHPVRAPRP

SEQ ID NO: 2847 - protein, 125 aa, Homo Sapiens
  Testis
  SIGNAL -106..-1: Von Heijne matrix
  score 4.10
  seq IITLACVPMTSFT/RN
  UNSURE -18: Xaa = Ile,Leu,Val
  UNSURE -105: Xaa = Leu,Trp
  UNSURE -62: Xaa = Lys,Asn
MXVYRLQTQEKPNTTVQVPAFLQELVDRDNSKFEEWCIEMAEMRXKVWIKEKQNTKRLRSCTKGYLLELSPMSLSLWNGCKSGWMNQQXPNLLIITLACVPMTSFTRNKISIMKRISEYAADIFY

SEQ ID NO: 2848 - protein, 27 aa, Homo Sapiens
  Testis
  SIGNAL -21..-1: Von Heijne matrix; score 3.90; seq LIAVVIIILLIFT/SV
MFPVLGWILIAVVIIILLIFTSVTRCL

SEQ ID NO: 2849 - protein, 65 aa, Homo Sapiens
  Testis
  SIGNAL -19..-1: Von Heijne matrix
  score 3.90
  seq SVCLCPCLNKGQS/EN
  UNSURE 37: Xaa =  * ,Trp
MFSCCISVCLCPCLNKGQSENLSRDCGHWLNPHHRRLWPFGRRHPQDCGLFQDSQXYGESKDWNG

SEQ ID NO: 2850 - protein, 88 aa, Homo Sapiens [sequence omitted]

SEQ ID NO: 2851 - protein, 47 aa, Homo Sapiens
  Testis
  SIGNAL -26..-1: Von Heijne matrix; score 10.50; seq LLLALLLPVQVSS/FV
MGKGMVAMLILGLLLLALLLPVQVSSFVPLTSMPEATAAETTKPSNG

SEQ ID NO: 2852 - protein, 55 aa, Homo Sapiens
  Testis
  SIGNAL -21..-1: Von Heijne matrix; score 9.50; seq LLVLFVLLANVQG/PG
MGSSGLLSLLVLFVLLANVQGPGLTDWLFPRRCPKIREECEFQERDVCTKDRQCR

SEQ ID NO: 2853 - protein, 78 aa, Homo Sapiens
  Ovary
  SIGNAL -35..-1: Von Heijne matrix; score 8.30; seq NLLLLHCVSRSHS/QN
MVLGGCPVSYLLLCGQAALLLGNLLLLHCVSRSHSQNATAEPELTSAGAPSRRAPGVLRAGNMATPTLRSSSALTYLG

SEQ ID NO: 2854 - protein, 44 aa, Homo Sapiens
  Testis
  SIGNAL -18..-1: Von Heijne matrix; score 8.30; seq LLSLSSLPLVLLG/WE
METGRLLSLSSLPLVLLGWEYSSQTLNLVPSTSILSFVPFIPRV

SEQ ID NO: 2855 - protein, 59 aa, Homo Sapiens
  Ovary
  SIGNAL -19..-1: Von Heijne matrix; score 8.20; seq QVLALVLVAALWG/GT
MAASLGQVLALVLVAALWGGTQPLLKRASAGLQRVHEPTWAQQLLQEMKTLFLNTEYLM

SEQ ID NO: 2856 - protein, 84 aa, Homo Sapiens
  Spleen
  SIGNAL -59..-1: Von Heijne matrix
  score 8.10
  seq FLLGISNLSQVRA/SN
  UNSURE 23: Xaa = Asn,Thr
MHIKSIILEGFKSYAQRTEVNGFDPLFNAITGLNGSGKSNILDSICFLLGISNLSQVRASNLQDLVYKNGQAGITKASVSIXFD

SEQ ID NO: 2857 - protein, 63 aa, Homo Sapiens
  Testis
  SIGNAL -19..-1: Von Heijne matrix
  score 8.00
  seq WGFLCVLFTAVHP/AP
  UNSURE 21: Xaa = Ala,Glu,Lys,Pro,Gln,Thr
  UNSURE 20: Xaa = His,Gln
MSPSPRWGFLCVLFTAVHPAPSTAPVQDKCPVNTWEAMXXVLPAAPANRPPTQAFPSASTATG

SEQ ID NO: 2858 - protein, 65 aa, Homo Sapiens
  Testis
  SIGNAL -24..-1: Von Heijne matrix; score 7.80; seq FLLCLCIAYWAST/AV
MCSLLYPLVTFFLLCLCIAYWASTAVFLSTSNEAVYKIFDDSPCPFTAKTCNPETFPSSNEPRHG

SEQ ID NO: 2859 - protein, 51 aa, Homo Sapiens
  Spleen
  SIGNAL -16..-1: Von Heijne matrix; score 7.60; seq FLFFSTLFSSIFT/EA
MLPFLFFSTLFSSIFTEAQKQYWVCNSSDASIHTPTVIKCNTQFQLMLTPG

SEQ ID NO: 2860 - protein, 86 aa, Homo Sapiens [sequence omitted]

SEQ ID NO: 2861 - protein, 121 aa, Homo Sapiens
  Testis
  SIGNAL -53..-1: Von Heijne matrix; score 7.10; seq IAVGLGVAALAFA/GR
MAARGVIAPVGESLRYAEYLQPSAKRPDADVDQQRLVRSLIAVGLGVAALAFAGRYAFRIWKPLEQVITETAKKISTPSFSSYYKGGFEQKMSRREAGLILGVSPSAGKAKIRTAHRRVMI

SEQ ID NO: 2862 - protein, 43 aa, Homo Sapiens [sequence omitted]

SEQ ID NO: 2863 - protein, 42 aa, Homo Sapiens
  Spleen
  SIGNAL -20..-1: Von Heijne matrix
  score 6.50
  seq GLCVLQLTTAVTS/AF
  UNSURE 12: Xaa = Ala,Thr
MPSVNSAGLCVLQLTTAVTSAFLLAKVNPFEXFLSRGFWLCA

SEQ ID NO: 2864 - protein, 31 aa, Homo Sapiens
  Ovary
  SIGNAL -20..-1: Von Heijne matrix
  score 6.40
  seq ALFLLVSXYMIRS/GT
  UNSURE -6: Xaa = Phe,Leu,Val
MMLGLHFALFLLVSXYMIRSGTGNKIEEGGR

SEQ ID NO: 2865 - protein, 48 aa, Homo Sapiens
  Testis
  SIGNAL -13..-1: Von Heijne matrix
  score 6.40
  seq MALLLSVLRVLLG/GF
  UNSURE 29: Xaa = Lys,Gln
MALLLSVLRVLLGGFFALVGLAKLSEEISAPVSERMNALFVXFAEVLG

SEQ ID NO: 2866 - protein, 41 aa, Homo Sapiens [sequence omitted]

SEQ ID NO: 2867 - protein, 24 aa, Homo Sapiens
  Ovary
  SIGNAL -15..-1: Von Heijne matrix
  score 6.10
  seq IVTWLLXSFMSSA/EE
  UNSURE -7: Xaa =  * ,Ser
MGIVTWLLXSFMSSAEESVSARTR

SEQ ID NO: 2868 - protein, 37 aa, Homo Sapiens
  Uterus
  SIGNAL -28..-1: Von Heijne matrix; score 6.00; seq IGLMFLMLGCALP/IY
MAGIKALISLSFGGAIGLMFLMLGCALPIYNKYWPPG

SEQ ID NO: 2869 - protein, 34 aa, Homo Sapiens [sequence omitted]

SEQ ID NO: 2870 - protein, 78 aa, Homo Sapiens
  Testis
  SIGNAL -40..-1: Von Heijne matrix; score 5.80; seq VLFALFVAFLLRG/KL
MDGIPMSMKNEMPISQLLMIIAPSLGFVLFALFVAFLLRGKLMETYCSQKHTRLDYIGDSKNVLNDVQHGREDEDGHG

SEQ ID NO: 2871 - protein, 91 aa, Homo Sapiens
  Uterus
  SIGNAL -57..-1: Von Heijne matrix; score 5.70; seq LAICSCLPGPGPA/LP
MGGFLHLPALSSSCLWTFPPMCVRIFSYVPLPILTPKTINLIPVLAICSCLPGPGPALPLPAFPTLLVSWYHCPPQKKTGMMDTDDFRACP

SEQ ID NO: 2872 - protein, 51 aa, Homo Sapiens
  Testis
  SIGNAL -19..-1: Von Heijne matrix; score 8.00; seq WGFLCVLFTAVHP/AP
MSPSPRWGFLCVLFTAVHPAPSTAPVQDKCPVNTWEAMQASSQQLLQTDPM

SEQ ID NO: 2873 - protein, 93 aa, Homo Sapiens
  Testis
  SIGNAL -76..-1: Von Heijne matrix
  score 5.30
  seq IILASASFSPNFT/QV
  UNSURE -32: Xaa = Ile,Val
MTSQPVPNETIIVLPSNVINFSQAEKPEPTNQGQDSLKKHLHAEXKVIGTIQILCGMMVLSLGIILASASFSPNFTQVTSTLLNSAYPFIGPG

SEQ ID NO: 2874 - protein, 127 aa, Homo Sapiens
  Testis
  SIGNAL -91..-1: Von Heijne matrix
  score 4.80
  seq IILRLPWLNRSQT/VV
  UNSURE 32: Xaa = Glu,Val
MRALENDFFNSPPRKTVRFGGTVTEVLLKYKKGETNDFELLKNQLLDPDIKDDQIINWLLEFRSSVMYLTKDFEQLISIILRLPWLNRSQTVVEEYLAFLGNLVSAETVFLRPCLSMIASHFXPPEL

SEQ ID NO: 2875 - protein, 57 aa, Homo Sapiens
  Spleen
  SIGNAL -31..-1: Von Heijne matrix; score 4.80; seq WAFSCGTWLPSRA/EW
MVFPAKRFCLVPSMEGVRWAFSCGTWLPSRAEWLLAVRSIQPEEKERIGQFVFARDG

SEQ ID NO: 2876 - protein, 93 aa, Homo Sapiens
  Testis
  SIGNAL -82..-1: Von Heijne matrix
  score 4.70
  seq LTCLADLFHSIAT/XK
  UNSURE 6: Xaa = Ala,Gly,Val
  UNSURE 1: Xaa = Glu,Gln
MNCFQGTNASALEKDIGPEQFPINEHYFGLVNFGNTCYCNSVLQALYSCRPFRENVLAYKAQQKKKENLLTCLADLFHSIATXKKKVXSSHLG

SEQ ID NO: 2877 - protein, 55 aa, Homo Sapiens
  Testis
  SIGNAL -16..-1: Von Heijne matrix
  score 4.60
  seq ALRVRXXXFGTRA/CR
  UNSURE -7: Xaa =  * ,Ser
  UNSURE -8: Xaa = Cys,Gly
  UNSURE 30: Xaa = His,Gln
  UNSURE -6,11: Xaa = Leu,Val
  UNSURE 18: Xaa = Ser,Thr
MAAALRVRXXXFGTRACRRHGLPHRAXWLRNRVXDRYFRIQEVLKXARHFRGRKR

SEQ ID NO: 2878 - protein, 45 aa, Homo Sapiens
  Testis
  SIGNAL -15..-1: Von Heijne matrix; score 4.60; seq LLTHNLLSSHVRG/VG
MKLLTHNLLSSHVRGVGSRGFPLRLQATEVRICPVEFNPNFVARR

SEQ ID NO: 2879 - protein, 61 aa, Homo Sapiens
  Testis
  SIGNAL -41..-1: Von Heijne matrix
  score 4.60
  seq VSAGSLLLPAPQA/EX
  UNSURE 6: Xaa =  * ,Arg,Trp
  UNSURE 2: Xaa = Asp,Glu
  UNSURE 7: Xaa = Ile,Val
  UNSURE -39: Xaa = Phe,Tyr
MGXFSRRTFCGRSGRSCRGQLVQVSRPEVSAGSLLLPAPQAEXHSSXXLYPRPKSLLPKMG

SEQ ID NO: 2880 - protein, 79 aa, Homo Sapiens
  Ovary
  SIGNAL -55..-1: Von Heijne matrix; score 4.60; seq CALSLPDAPGASG/GR
MEGGVRLDLSACGETSGVAVSELPASETAALVPEGHGPGLRACALSLPDAPGASGGRHHLILVPGQQHTGLPASHVHPQ

SEQ ID NO: 2881 - protein, 18 aa, Homo Sapiens
  Ovary
  SIGNAL -14..-1: Von Heijne matrix; score 4.50; seq TLLSFAALTAAFS/VL
MTLLSFAALTAAFSVLPK

SEQ ID NO: 2882 - protein, 78 aa, Homo Sapiens
  Ovary
  SIGNAL -21..-1: Von Heijne matrix
  score 4.40
  seq GLSKLQFAPFSSA/LD
  UNSURE 38: Xaa = Leu,Met
MAAATGDPGLSKLQFAPFSSALDVGFWHELTQKKLNEYRLDEAPKDIKGYYYNGDSAGXPARLTLEFSAFDMSAPTPS

SEQ ID NO: 2883 - protein, 32 aa, Homo Sapiens
  Spleen
  SIGNAL -27..-1: Von Heijne matrix
  score 4.40
  seq LSKSLLLVPSXLS/LL
  UNSURE -3: Xaa = Ala,Thr
  UNSURE 3: Xaa = Pro,Arg
MFTSTGSSGLYKAPLSKSLLLVPSXLSLLXAQ

SEQ ID NO: 2884 - protein, 83 aa, Homo Sapiens
  Testis
  SIGNAL -40..-1: Von Heijne matrix; score 4.30; seq ITLVSAAPGKVIC/EM
MTSMTQSLREVIKAMTKARNFERVLGKITLVSAAPGKVICEMKVEEEHTNAIGTLHGGLTATLVDNISTMALLCTERGAPGVS

SEQ ID NO: 2885 - protein, 86 aa, Homo Sapiens
  Spleen
  SIGNAL -73..-1: Von Heijne matrix
  score 4.30
  seq DIILSGLVPGSTT/LH
  UNSURE -14: Xaa = Phe,Leu,Val
MADFGISAGQFVAVVWDKSSPVEALKGLVDKLQALTGNEGRVSVENIKQLLQSAHKESSXDIILSGLVPGSTTLHSAEILAEIARV

SEQ ID NO: 2886 - protein, 16 aa, Homo Sapiens
  Ovary
  SIGNAL -14..-1: Von Heijne matrix; score 4.20; seq GILLGLLLLGHLT/VR
MGILLGLLLLGHLTVR

SEQ ID NO: 2887 - protein, 144 aa, Homo Sapiens
  Testis
  SIGNAL -19..-1: Von Heijne matrix; score 4.10; seq LLLGQRCSLKVSG/QE
MFLTVKLLLGQRCSLKVSGQESVATLKRLVSRRLKVPEEQQHLLFRGQLLEDDKHLSDYCIGPNASINVIMQPLEKMALKEAHQPQTQPLWHQLGLVLAKHFEPQDAKAVLQLLRQEHEERLQKISLEHLEQLAQYLLAEELTW

SEQ ID NO: 2888 - protein, 106 aa, Homo Sapiens
  Testis
  SIGNAL -32..-1: Von Heijne matrix; score 4.10; seq RLLSSLLLTMSNN/NP
MNVIDHVRDMAAAGLHSNVRLLSSLLLTMSNNNPELFSPPQKYQLLVYHADSLFHDKEYRNAVSKYTMALQQKKALSKTSKVRPSTGNSASTPQSQCLPSEIEVKY

SEQ ID NO: 2889 - protein, 59 aa, Homo Sapiens
  Testis
  SIGNAL -41..-1: Von Heijne matrix
  score 4.10
  seq RVLCPLLXAAAAP/KR
  UNSURE -6: Xaa =  * ,Leu
MGTPSLSILLIGAPESPIPYFPYHSGTGRVLCPLLXAAAAPKRDVPETGLTRQLKRHPG

SEQ ID NO: 2890 - protein, 57 aa, Homo Sapiens
  Testis
  SIGNAL -26..-1: Von Heijne matrix; score 3.90; seq HALFVLCLLYAMS/HN
MVYHALDSPDDDYHALFVLCLLYAMSHNKGMDPEKLERIQLPVPNAAEKTTYNHPHG

SEQ ID NO: 2891 - protein, 24 aa, Homo Sapiens
  Spleen
  SIGNAL -14..-1: Von Heijne matrix; score 3.80; seq FIVLSMWLCCGFE/IL
MFIVLSMWLCCGFEILQTKSWVAG

SEQ ID NO: 2892 - protein, 24 aa, Homo Sapiens
  Spleen
  SIGNAL -15..-1: Von Heijne matrix
  score 3.80
  seq VVILSSXVPLAAM/GV
  UNSURE -7: Xaa = Ala,Val
MVVVILSSXVPLAAMGVMGCVRVW

SEQ ID NO: 2893 - protein, 67 aa, Homo Sapiens [sequence omitted]

SEQ ID NO: 2894 - protein, 31 aa, Homo Sapiens
  Ovary
  SIGNAL -15..-1: Von Heijne matrix; score 3.80; seq MARLLGLCAWARK/SV
MQMARLLGLCAWARKSVRMASSRMTRRDPPR

SEQ ID NO: 2895 - protein, 47 aa, Homo Sapiens
  Uterus
  SIGNAL -43..-1: Von Heijne matrix; score 3.80; seq LISVLYLIPKTLT/TN
MTPQYLPHGGKYQVLGDYSLAVVFPLHFSDLISVLYLIPKTLTTNSR

SEQ ID NO: 2896 - protein, 115 aa, Homo Sapiens
  Spleen
  SIGNAL -23..-1: Von Heijne matrix
  score 3.70
  seq FLPPLXRAFACRG/CQ
  UNSURE -8: Xaa = Cys,Ser
MVVLRAGKKTFLPPLXRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHS

SEQ ID NO: 2897 - protein, 33 aa, Homo Sapiens
  Testis
  SIGNAL -20..-1: Von Heijne matrix; score 3.60; seq AHLCSDSLPESQQ/QD
MKREGGAAHLCSDSLPESQQQDGNHAPNFSSHG

SEQ ID NO: 2898 - protein, 46 aa, Homo Sapiens
  Testis
  SIGNAL -41..-1: Von Heijne matrix; score 3.60; seq PYSLAACPCGSQG/GV
MVTCPGPSSGQPLSSMYTAGDRRGAPSLPYSLAACPCGSQGGVCMR

SEQ ID NO: 2899 - protein, 104 aa, Homo Sapiens
  Spleen
  SIGNAL -18..-1: Von Heijne matrix; score 3.50; seq ALEVIVTLSETAA/AM
MQRQLALEVIVTLSETAAAMLRKHTNIVAQTIPQMLAMMVDLEEDEDWANADELEDDDFDSNAVAGESALDRMACGLGGKLVLPMIKEHIMQMLQNRKLCPSML

SEQ ID NO: 2900 - protein, 82 aa, Homo Sapiens
  Testis
  SIGNAL -76..-1: Von Heijne matrix; score 3.50; seq LASASELPLGSRP/AP
MGDYLLRGYRMLGETCADCGTILLQDKQRKIYCVACQELDSDVDKDNPALNAQAALSQAREHQLASASELPLGSRPAPQPHG

SEQ ID NO: 2901 - protein, 41 aa, Homo Sapiens
  Ovary
  SIGNAL -15..-1: Von Heijne matrix; score 8.10; seq LLYLLVPALFCRA/GG
MWLLYLLVPALFCRAGGSIPIPQKLFGEVTSPLFPKPYPNT

SEQ ID NO: 2902 - protein, 75 aa, Homo Sapiens
  Testis
  SIGNAL -58..-1: Von Heijne matrix
  score 4.00
  seq LAAVSPLVRSLIS/SN
  UNSURE -48: Xaa = Asp,Asn
  UNSURE -49: Xaa = Asp,His,Tyr
MKLEFTEKNXXSFVLQNLNRQRKRKEYWDMALSVDNHVFFAHRNVLAAVSPLVRSLISSNDMKTADELFITIDTK

SEQ ID NO: 2903 - protein, 96 aa, Homo Sapiens
  liver
  SIGNAL -20..-1: Von Heijne matrix
  score 15.80
  seq LLLLLLLRHGAQG/KP
  UNSURE 70: Xaa = Glu,Gly
MMWRPSVLLLLLLLRHGAQGKPSPDAGPHGQGRVHQAAPLSDAPHDDAHGNFQYDHEAFLGREVAKEFDQLTPEESQARLGRIVDRMDRXGTATAG

SEQ ID NO: 2904 - protein, 30 aa, Homo Sapiens
  Lung (cells)
  SIGNAL -28..-1: Von Heijne matrix; score 11.40; seq LLLILFLYGLCSG/WR
MGKICKNWVSFLDNVLLLILFLYGLCSGWR

SEQ ID NO: 2905 - protein, 52 aa, Homo Sapiens
  Large intestine
  SIGNAL -18..-1: Von Heijne matrix; score 11.10; seq LLALLCASASGNA/IQ
MLTVALLALLCASASGNAIQARSSSYSGEYGLVVESDSLILATSWTAPSPPT

SEQ ID NO: 2906 - protein, 32 aa, Homo Sapiens
  Pancreas
  SIGNAL -13..-1: Von Heijne matrix; score 10.40; seq MVLLLCLSCLIFS/CL
MVLLLCLSCLIFSCLTFSWLKIWGKMTDSKPM

SEQ ID NO: 2907 - protein, 90 aa, Homo Sapiens
  Liver
  SIGNAL -21..-1: Von Heijne matrix; score 10.00; seq LWALAMVTRPASA/AP
MPVPALCLLWALAMVTRPASAAPMGGPELAQHEELTLLFHGTLQLGQALNGVYRTTEGRLTKARNSLGLYGRTIELLGQEVSRGRDAAQG

SEQ ID NO: 2908 - protein, 44 aa, Homo Sapiens [sequence omitted]

SEQ ID NO: 2909 - protein, 77 aa, Homo Sapiens
  Lung
  SIGNAL -26..-1: Von Heijne matrix
  score 9.20
  seq FLLMTLLLGGLTG/VA
  UNSURE 23: Xaa =  * ,Lys,Ser,Thr
  UNSURE 3: Xaa = Gly,Val
  UNSURE 35: Xaa = His,Pro
  UNSURE 10: Xaa = Ile,Val
  UNSURE 42: Xaa = Phe,Leu
  UNSURE 32: Xaa = Ser,Thr
MPVPASWPHLPSPFLLMTLLLGGLTGVAXEEELQVXQPDKSISVAAGKXATLHCTVTXLIXVGPIQWXRGAGPGREL

SEQ ID NO: 2910 - protein, 93 aa, Homo Sapiens
  Large intestine
  SIGNAL -23..-1: Von Heijne matrix; score 9.10; seq LVAMLLLVFPTVS/RS
MAQRCVCVLALVAMLLLVFPTVSRSMGPRSGEHQRASRIPSQFSKEERVAMKEALKGAIQIPTVTFSSEKSNTTALAEFGNTFIKSFLQWSAP

SEQ ID NO: 2911 - protein, 19 aa, Homo Sapiens
  Lung (cells)
  SIGNAL -16..-1: Von Heijne matrix; score 9.00; seq LISFLLLLLLLLP/AR
MDYLISFLLLLLLLLPARG

SEQ ID NO: 2912 - protein, 88 aa, Homo Sapiens
  Colon
  SIGNAL -84..-1: Von Heijne matrix; score 8.90; seq LLGVLGIFGLTFA/FI
MATTVPDGCRNGLKSKYYRLCDKAEAWGIVLETVATAGVVTSVAFMLTLPILVCKVQDSNRRKMLPTQFLFLLGVLGIFGLTFAFIIG

SEQ ID NO: 2913 - protein, 71 aa, Homo Sapiens
  Large intestine
  SIGNAL -19..-1: Von Heijne matrix
  score 8.90
  seq WLFLVIFIKGVQC/QE
  UNSURE 33: Xaa = Cys,Phe,Ser,Tyr
MESGLSWLFLVIFIKGVQCQEQLVESGGGVVKPGGSLRLSCEASGFTFSDFXMMWIRQTPGKGLEYVGIHQ

SEQ ID NO: 2914 - protein, 21 aa, Homo Sapiens [sequence omitted]

SEQ ID NO: 2915 - protein, 53 aa, Homo Sapiens
  Lung (cells)
  SIGNAL -17..-1: Von Heijne matrix; score 8.60; seq LLPVSLLLSVAVS/AI
MLQGLLPVSLLLSVAVSAIKELPGVKKYEVVYPIRLHPLHKREAKEPEQQERR

SEQ ID NO: 2916 - protein, 30 aa, Homo Sapiens [sequence omitted]

SEQ ID NO: 2917 - protein, 37 aa, Homo Sapiens
  Liver
  SIGNAL -33..-1: Von Heijne matrix; score 8.20; seq LLCSLLFSFPFLC/HP
MIFADRTHSSAFTLMRSYSLLLCSLLFSFPFLCHPLR

SEQ ID NO: 2918 - protein, 72 aa, Homo Sapiens
  Pancreas
  SIGNAL -20..-1: Von Heijne matrix; score 8.00; seq VCVLVGSFSASLA/GT
MAFLPSWVCVLVGSFSASLAGTSNLSETEPPLWKESPGQLSDYRVENSMYIINPWVYLERMGMYKIILNQTK

SEQ ID NO: 2919 - protein, 26 aa, Homo Sapiens
  Lung (cells)
  SIGNAL -14..-1: Von Heijne matrix; score 7.70; seq FLVSCVICTGSFA/FN
MFLVSCVICTGSFAFNNSNVPLPSSR

SEQ ID NO: 2920 - protein, 68 aa, Homo Sapiens
  Lung (cells)
  SIGNAL -44..-1: Von Heijne matrix
  score 7.50
  seq LMIPLLLLTPITA/TS
  UNSURE 3: Xaa = Asn,Thr
MKKTGDGGTLSTERIGGAALLSLLLKRMKMTLMIPLLLLTPITATSXSRWPEIGVVAIRSQLRALHTC

SEQ ID NO: 2921 - protein, 116 aa, Homo Sapiens
  Lung (cells)
  SIGNAL -25..-1: Von Heijne matrix
  score 7.50
  seq XILLAGWCPDTRA/GG
  UNSURE -13: Xaa =  * ,Gly
  UNSURE 76: Xaa = Ala,Cys,Gly,Pro,Arg,Ser,Thr
  UNSURE 54: Xaa = Asp,Glu
  UNSURE 57: Xaa = Pro,Thr
MGFFLPHGISDAXILLAGWCPDTRAGGWADLCLPENRGPKPPSPRSALGSGRGLGSGQPEVEPPAPEQAWESLQGGLGXCSXARPSPGFWARASLAVGAGXVGGTLLNWEIASDLQ

SEQ ID NO: 2922 - protein, 73 aa, Homo Sapiens [sequence omitted]

SEQ ID NO: 2923 - protein, 48 aa, Homo Sapiens
  Lung
  SIGNAL -39..-1: Von Heijne matrix
  score 7.40
  seq LFLLSLFCRLYHG/TI
  UNSURE -17: Xaa = Asp,Tyr
MSEGMVTLLTFSCLWTDDSFMSXLNVLFLLSLFCRLYHGTIFFLLALL

SEQ ID NO: 2924 - protein, 53 aa, Homo Sapiens [sequence omitted]

SEQ ID NO: 2925 - protein, 49 aa, Homo Sapiens
  Lung
  SIGNAL -25..-1: Von Heijne matrix
  score 7.30
  seq HFILLVLPCLIFS/HF
  UNSURE -16: Xaa = Gly,Val
MYIYFFVLCXLSHFILLVLPCLIFSHFTLFLFYSALLDIPLFFKYSLIE

SEQ ID NO: 2926 - protein, 69 aa, Homo Sapiens
  Lung
  SIGNAL -42..-1: Von Heijne matrix
  score 7.20
  seq ILFSLSFLLVIIT/FP
  UNSURE 18: Xaa = Ala,Asp
  UNSURE 14: Xaa = Ala,Glu
MDSRVSSPEKQDKENFVGVNNKRLGVCGWILFSLSFLLVIITFPISIWMCLKIIKXYERXVVFRLGRHG

SEQ ID NO: 2927 - protein, 18 aa, Homo Sapiens
  Thyroid
  SIGNAL -16..-1: Von Heijne matrix; score 7.00; seq LFCVVLCLSPTSY/CY
MCILFCVVLCLSPTSYCY

SEQ ID NO: 2928 - protein, 28 aa, Homo Sapiens
  Lung (cells)
  SIGNAL -19..-1: Von Heijne matrix; score 7.00; seq ETLLCLGSSCCQC/RI
MHRGDIETLLCLGSSCCQCRIFSFFFFF

SEQ ID NO: 2929 - protein, 27 aa, Homo Sapiens
  Lung
  SIGNAL -19..-1: Von Heijne matrix; score 7.00; seq AGLSSCLLPLCWL/ER
MFLKSGAGLSSCLLPLCWLERKDHGRR

SEQ ID NO: 2930 - protein, 120 aa, Homo Sapiens
  Lung (cells)
  SIGNAL -38..-1: Von Heijne matrix; score 7.00; seq LVMVWLGLLPLFS/GP
MANAIIKKPCAMPAQPHTGNLLWPPLVMVWLGLLPLFSGPHLQAVQHLALAYLPLNSVVLAHNSPAILNVWLTLRCPLPYRICLWPFEHAFPSIRNTHSCLSSSCCCPASAPLLVDYLFF

SEQ ID NO: 2931 - protein, 130 aa, Homo Sapiens
  Lung
  SIGNAL -19..-1: Von Heijne matrix
  score 6.90
  seq LQPLLLLLPLLNV/EP
  UNSURE 29: Xaa = Ile,Arg
MSPPPLLQPLLLLLPLLNVEPSGATLIRIPLHRVQPGRRILNLLRGWXEPAELPKLGAPSPGDKPIFVPLSNYRDVQYFGEIGLGTPPQNFTVAFDTGSSNLWVPSRRCHFFSVPCWLHTDLIPKPLAPS

SEQ ID NO: 2932 - protein, 44 aa, Homo Sapiens
  liver
  SIGNAL -42..-1: Von Heijne matrix; score 6.50; seq ILIGLFSLTGLVA/GN
MIPIYQNKSQTDSHCSLSHKGLAFLKVWLILIGLFSLTGLVAGN

SEQ ID NO: 2933 - protein, 40 aa, Homo Sapiens [sequence omitted]

SEQ ID NO: 2934 - protein, 62 aa, Homo Sapiens
  Colon
  SIGNAL -41..-1: Von Heijne matrix
  score 6.40
  seq IALIPLFSTXAFA/IX
  UNSURE -19: Xaa =  * ,Gln
  UNSURE 2,14: Xaa = Ala,Ser,Thr
  UNSURE -20: Xaa = Asn,Ser
  UNSURE 17: Xaa = Gly,Arg
  UNSURE -4: Xaa = Ser,Thr
MPSETLWEIAKAEVEKRGINGXXGDGAEIALIPLFSTXAFAIXQIVSLGIVDGSXPPXSRTP

SEQ ID NO: 2935 - protein, 58 aa, Homo Sapiens [sequence omitted]

SEQ ID NO: 2936 - protein, 41 aa, Homo Sapiens [sequence omitted]

SEQ ID NO: 2937 - protein, 45 aa, Homo Sapiens
  Liver
  SIGNAL -29..-1: Von Heijne matrix; score 6.30; seq SLPLALTLSLSTS/LH
MDVSASKPVAESWSPGSLPLALTLSLSTSLHDSWKEPIPNLHQPA

SEQ ID NO: 2938 - protein, 39 aa, Homo Sapiens
  Liver
  SIGNAL -28..-1: Von Heijne matrix
  score 6.20
  seq IQTALLGLPXAWA/SS
  UNSURE -4: Xaa = Lys,Arg
MGVRVGVSLRAWCVFIQTALLGLPXAWASSGVVSSTGPG

SEQ ID NO: 2939 - protein, 29 aa, Homo Sapiens [sequence omitted]

SEQ ID NO: 2940 - protein, 54 aa, Homo Sapiens
  Thyroid
  SIGNAL -29..-1: Von Heijne matrix
  score 5.90
  seq WTLVLMSPEWALL/QY
  UNSURE 12: Xaa =  * ,Cys,Pro,Arg,Ser
MTMQRSRSSSWTSCNSWTLVLMSPEWALLQYGSTVKNEFSXKTFKRKSEVERAV

SEQ ID NO: 2941 - protein, 30 aa, Homo Sapiens
  Lung (cells)
  SIGNAL -23..-1: Von Heijne matrix; score 5.80; seq LCSLMASISPTLT/AV
MITLPQTSSLLCSLMASISPTLTAVILWPP

SEQ ID NO: 2942 - protein, 78 aa, Homo Sapiens
  Liver
  SIGNAL -63..-1: Von Heijne matrix
  score 5.70
  seq PLVTHGLLLQAWS/RR
  UNSURE 10: Xaa = Gly,Ser
MLRTCYVLCSQAGPPSRGWQSLSFDGGAFHLKGTGELTRALLVLRLCAWPPLVTHGLLLQAWSRRLLGSRLSXAFLRA

SEQ ID NO: 2943 - protein, 41 aa, Homo Sapiens
  Lung (cells)
  SIGNAL -30..-1: Von Heijne matrix; score 5.70; seq LGVGCHFFHLALG/RF
MICSPFSGFAPCQALGTLGVGCHFFHLALGRFLLSLSNNIY

SEQ ID NO: 2944 - protein, 150 aa, Homo Sapiens
  Pancreas
  SIGNAL -98..-1: Von Heijne matrix
  score 5.60
  seq LLLLRGADRVLQA/HI
  UNSURE 20: Xaa = Ala,Glu,Val
  UNSURE -89: Xaa = Leu,Arg
  UNSURE 33: Xaa = Lys,Asn
MCNPEEAALXGLEEVFSATLAHVNSLVLQPLLPAAPDPSDPWGRECLRLLQQLHKSSQQLWEVTEESLHSLQERLRYPDSTGLESLLLLRGADRVLQAHIEYIESYTSCMVVQAFQKXAKRRSEFWRGQRXALRQLLSGVSSEGSVGASL

SEQ ID NO: 2945 - protein, 70 aa, Homo Sapiens
  Thyroid
  SIGNAL -45..-1: Von Heijne matrix; score 5.60; seq LLVIHWVMCPSLS/QS
MDKLIPSLSSQENRKASHTLHKARNKQHCGGFLLVIHWVMCPSLSQSAVRRMKYSNWPVLGHVPVPGCHC

SEQ ID NO: 2946 - protein, 35 aa, Homo Sapiens
  Lung (cells)
  SIGNAL -17..-1: Von Heijne matrix
  score 5.50
  seq LPVVLASPPVGHG/LP
  UNSURE -15: Xaa = His,Gln
MSXLLPVVLASPPVGHGLPSPVPLLQDPCPLPAVG

SEQ ID NO: 2947 - protein, 25 aa, Homo Sapiens
  Lung (cells)
  SIGNAL -13..-1: Von Heijne matrix; score 5.50; seq MVLLTMIARVADG/LP
MVLLTMIARVADGLPLAASMQEDEE

SEQ ID NO: 2948 - protein, 59 aa, Homo Sapiens [sequence omitted]

SEQ ID NO: 2949 - protein, 38 aa, Homo Sapiens
  Pancreas
  SIGNAL -25..-1: Von Heijne matrix
  score 5.40
  seq SLLTETVLPLAFP/GP
  UNSURE 12: Xaa = Gly,Val
MMHCTPSGSAAVSLLTETVLPLAFPGPPWLGTSFNRXL

SEQ ID NO: 2950 - protein, 74 aa, Homo Sapiens
  Lung
  SIGNAL -28..-1: Von Heijne matrix; score 5.30; seq RISCAFSLASSTA/RQ
MTRPFWASCSTWATSRISCAFSLASSTARQTSIACCATHRTAWASRPGPRRPWCCRYSKPLTTWPVRMMRREGL

SEQ ID NO: 2951 - protein, 87 aa, Homo Sapiens
  Lung (cells)
  SIGNAL -26..-1: Von Heijne matrix
  score 5.20
  seq SCCLIQWPELSFS/NT
  UNSURE 15: Xaa = Arg,Thr
  UNSURE 16: Xaa = Cys,Ser
MVTHLIRGVVLQGSCCLIQWPELSFSNTNGVCPIYPPPSIXXLRMSSCSPLTVSLCPCYVECASTPGPLCLLFSWPRNTSPNMPSGY

SEQ ID NO: 2952 - protein, 65 aa, Homo Sapiens
  Lung (cells)
  SIGNAL -19..-1: Von Heijne matrix; score 5.20; seq LLVAFRVFLGLFS/LP
MYMWSKLLVAFRVFLGLFSLPSNHNTYCPFQPWGIPCSLRIGGLLHLQCPLPPSLHPLPSLLTSR

SEQ ID NO: 2953 - protein, 45 aa, Homo Sapiens [sequence omitted]

SEQ ID NO: 2954 - protein, 36 aa, Homo Sapiens
  Lung (cells)
  SIGNAL -18..-1: Von Heijne matrix; score 5.10; seq CLYLHVYVLTCSG/CN
MYMNTCLYLHVYVLTCSGCNVDMCSRLFLSTKLKAR

SEQ ID NO: 2955 - protein, 56 aa, Homo Sapiens [sequence omitted]

SEQ ID NO: 2956 - protein, 25 aa, Homo Sapiens
  Thyroid
  SIGNAL -20..-1: Von Heijne matrix; score 5.10; seq PTAGVVVLQGSRA/SV
MITGCTKPTAGVVVLQGSRASVRQR

SEQ ID NO: 2957 - protein, 17 aa, Homo Sapiens
  Lung (cells)
  SIGNAL -14..-1: Von Heijne matrix; score 5.00; seq GLDLILSFSSSSP/GP
MGLDLILSFSSSSPGPG

SEQ ID NO: 2958 - protein, 69 aa, Homo Sapiens
  Colon
  SIGNAL -62..-1: Von Heijne matrix; score 4.90; seq LDRLCALTSLCSP/GP
MREDNEHERNVPSGVENVKEEGGDEDLSWGDEGCQVLRHRLRVCRKVGLLDRLCALTSLCSPGPLPATL

SEQ ID NO: 2959 - protein, 29 aa, Homo Sapiens
  Colon
  SIGNAL -18..-1: Von Heijne matrix
  score 4.90
  seq GAVVSSWAXCSLG/XP
  UNSURE 1: Xaa = Gly,Leu,Arg,Val
  UNSURE -5: Xaa = His,Gln
MGKRAGAVVSSWAXCSLGXPGIQRSSRLT

SEQ ID NO: 2960 - protein, 82 aa, Homo Sapiens
  Lung (cells)
  SIGNAL -21..-1: Von Heijne matrix; score 4.90; seq WLLSDILGQGATA/NV
MQSTSNHLWLLSDILGQGATANVFRGRHKKTGDLFAIKVFNNISFLRPVDVQMREFEVLKKLNHKNIVKLFAIEEETTTRRR

SEQ ID NO: 2961 - protein, 67 aa, Homo Sapiens
  liver
  SIGNAL -49..-1: Von Heijne matrix; score 4.90; seq LLCLSGLELEPSA/SD
MKKLRPSQEQLNCPEPQLADGRAGIRLLVTWLQPAPLLCLSGLELEPSASDFGFSSHTTLLCCLVEN

SEQ ID NO: 2962 - protein, 74 aa, Homo Sapiens
  Large intestine
  SIGNAL -19..-1: Von Heijne matrix; score 4.90; seq RLLFWSIFSSVTC/RK
MWSHLNRLLFWSIFSSVTCRKAVLDCEAMKTNEFPSPCLDSKTKVVMKGQNVSMFCSHKNKSLQITYSLFRRKT

SEQ ID NO: 2963 - protein, 83 aa, Homo Sapiens
  Lung (cells)
  SIGNAL -52..-1: Von Heijne matrix; score 4.80; seq SLLLAQATSNVVC/SL
MLALRDLGMGKREGEELIQAEARCLVETFQGTEGRPFDPSLLLAQATSNVVCSLLFGLRFSYEDKEFQAVVRAAGGTCWESAP

SEQ ID NO: 2964 - protein, 67 aa, Homo Sapiens [sequence omitted]

SEQ ID NO: 2965 - protein, 23 aa, Homo Sapiens
  Lung
  SIGNAL -19..-1: Von Heijne matrix; score 4.80; seq VLLSQFLYPLAYP/HP
MFQQMYVLLSQFLYPLAYPHPIG

SEQ ID NO: 2966 - protein, 24 aa, Homo Sapiens
  Lung (cells)
  SIGNAL -16..-1: Von Heijne matrix
  score 4.80
  seq HFCXIGFLSYTTS/LV
  UNSURE -10: Xaa = Leu,Val
MTSHFCXIGFLSYTTSLVYWNAGR

SEQ ID NO: 2967 - protein, 47 aa, Homo Sapiens [sequence omitted]

SEQ ID NO: 2968 - protein, 34 aa, Homo Sapiens
  Colon
  SIGNAL -27..-1: Von Heijne matrix; score 4.70; seq PALTLTFLPPSPT/LP
MEPPGRSSSLPFSPPALTLTFLPPSPTLPLPSPG

SEQ ID NO: 2969 - protein, 63 aa, Homo Sapiens
  Colon
  SIGNAL -55..-1: Von Heijne matrix; score 4.70; seq IGILCSLLGTVLL/WV
MDKLKKVLSGQDTEDRSGLSEVVEASSLSWSTRIKGFIACFAIGILCSLLGTVLLWVPRKGHG

SEQ ID NO: 2970 - protein, 32 aa, Homo Sapiens [sequence omitted]

SEQ ID NO: 2971 - protein, 55 aa, Homo Sapiens
  Lung (cells)
  SIGNAL -24..-1: Von Heijne matrix
  score 4.60
  seq SLLLYSLPLNIIG/LN
  UNSURE 21: Xaa = His,Pro,Arg
MYPSLLVDYFPSLLLYSLPLNIIGLNCAYPLINNFLKNNSYTCVXVPLAFPSMPS

SEQ ID NO: 2972 - protein, 79 aa, Homo Sapiens
  Lung (cells)
  SIGNAL -77..-1: Von Heijne matrix
  score 4.50
  seq LPTQFLFLLGVLG/IF
  UNSURE -31: Xaa = Leu,Arg
MATTVPDGCRNGLKSKYYRLCDKAEAWGIVLETVATAGVVTSVAFMXTLPILVCKVQDSNRRKMLPTQFLFLLGVLGIF

SEQ ID NO: 2973 - protein, 68 aa, Homo Sapiens
  Large intestine
  SIGNAL -17..-1: Von Heijne matrix; score 4.50; seq HLDHLFFSGVVLG/QG
MRLQHLDHLFFSGVVLGQGLDLGRVCLRKWGYRRCEDICWIKTNKNNPGKTKTLDPKAVFQRTKAGLG

SEQ ID NO: 2974 - protein, 78 aa, Homo Sapiens [sequence omitted]

SEQ ID NO: 2975 - protein, 94 aa, Homo Sapiens
  Pancreas
  SIGNAL -75..-1: Von Heijne matrix
  score 4.40
  seq QXRLCVSPSGLRC/EP
  UNSURE -14: Xaa = Lys,Met,Arg,Thr
  UNSURE -12: Xaa = Phe,Ile,Leu,Val
MEPITFTARKHLLPNEVSVDFGLQLVGSLPVHSLTTMPMLPWVVAEVRRLSRQSTRKEPVTXQXRLCVSPSGLRCEPEPGRSQQWDPLIYSSIF

SEQ ID NO: 2976 - protein, 40 aa, Homo Sapiens
  Colon
  SIGNAL -25..-1: Von Heijne matrix; score 4.40; seq FFCWEVGVSGSSA/GP
MGCLWGLALPLFFFCWEVGVSGSSAGPSTRRADTAMTTDD

SEQ ID NO: 2977 - protein, 38 aa, Homo Sapiens [sequence omitted]

SEQ ID NO: 2978 - protein, 51 aa, Homo Sapiens [sequence omitted]

SEQ ID NO: 2979 - protein, 28 aa, Homo Sapiens
  Colon
  SIGNAL -23..-1: Von Heijne matrix
  score 4.30
  seq QXILLGTTSVVTA/AL
  UNSURE -12: Xaa = Cys,Phe
MESGGRPSLCQXILLGTTSVVTAALYSV

SEQ ID NO: 2980 - protein, 91 aa, Homo Sapiens
  Pancreas
  SIGNAL -43..-1: Von Heijne matrix
  score 4.20
  seq HMMAAAVADGTRA/AT
  UNSURE -21: Xaa = Glu,Gln
MEAQQAQKSAEQPEQKAATEVSXELSESQVHMMAAAVADGTRAATIIEERSPSWISASVTEPLEQVEAEAALLTEEVLEREVIAEEEPPTM

SEQ ID NO: 2981 - protein, 21 aa, Homo Sapiens
  Lung (cells)
  SIGNAL -17..-1: Von Heijne matrix
  score 4.20
  seq SVIWFGSVXPCIS/XV
  UNSURE 1: Xaa = His,Gln
  UNSURE -5: Xaa = Phe,Ile,Asn,Ser,Thr,Tyr
MPLNSVIWFGSVXPCISXVEL

SEQ ID NO: 2982 - protein, 37 aa, Homo Sapiens
  Lung
  SIGNAL -30..-1: Von Heijne matrix; score 4.20; seq FLDFANLADLTLA/ES
MLQQLDSISLRRRETANFLDFANLADLTLAESEVFRL

SEQ ID NO: 2983 - protein, 56 aa, Homo Sapiens
  Lung (cells)
  SIGNAL -48..-1: Von Heijne matrix
  score 4.10
  seq FTTLSNLSLPSQT/KD
  UNSURE -35: Xaa = His,Asn
  UNSURE -36: Xaa = Leu,Arg
MCYLAELSLTTFXXGYIVTSRATTTTTLAIQPGLPFTTLSNLSLPSQTKDELHPPW

SEQ ID NO: 2984 - protein, 24 aa, Homo Sapiens
  Pancreas
  SIGNAL -17..-1: Von Heijne matrix; score 4.10; seq LSSLILLPIWINM/AQ
MSISLSSLILLPIWINMAQIQRGG

SEQ ID NO: 2985 - protein, 125 aa, Homo Sapiens
  Lung
  SIGNAL -86..-1: Von Heijne matrix; score 4.00; seq LLFALSWKSDAPA/TS
MDRDLLRQSLNCHGSSLLSLLRSEQQDNPHFRSLLGSAAEPARGPPPQHPLQGRKEKRVDNIEIQKFISKKADLLFALSWKSDAPATSEINEDSEDHYAIMPPLEQFMEIPSMDRRELFFRDIER

SEQ ID NO: 2986 - protein, 25 aa, Homo Sapiens
  Large intestine
  SIGNAL -17..-1: Von Heijne matrix
  score 4.00
  seq TLVTXXNASCSFA/SV
  UNSURE -9: Xaa = Cys,Ser
  UNSURE -8: Xaa = Leu,Val
MVLATLVTXXNASCSFASVHLAQGG

SEQ ID NO: 2987 - protein, 39 aa, Homo Sapiens [sequence omitted]

SEQ ID NO: 2988 - protein, 100 aa, Homo Sapiens
  liver
  SIGNAL -61..-1: Von Heijne matrix; score 4.00; seq AALVKCLPVLCLA/GF
MDAGKAGQTLKTHCSAQRPDVCRWLSPFILSCCVYFCLWIPEDQLSWFAALVKCLPVLCLAGFLWVMSPSGGYTQLLQGALVCSAVGDACLIWPAAFVPG

SEQ ID NO: 2989 - protein, 70 aa, Homo Sapiens
  Lung (cells)
  SIGNAL -28..-1: Von Heijne matrix; score 4.00; seq PLLGVLFFQGVYI/VF
MQQRGAAGSRGCALFPLLGVLFFQGVYIVFSLEIRADAHVRGYVGEKIKLKCTFKSTSDVTDKLTIDWTQ

SEQ ID NO: 2990 - protein, 51 aa, Homo Sapiens [sequence omitted]

SEQ ID NO: 2991 - protein, 21 aa, Homo Sapiens
  Pancreas
  SIGNAL -19..-1: Von Heijne matrix; score 3.90; seq FLNLHGFLGHLLS/GE
MSIYNLFLNLHGFLGHLLSGE

SEQ ID NO: 2992 - protein, 29 aa, Homo Sapiens
  Lung (cells)
  SIGNAL -25..-1: Von Heijne matrix
  score 3.90
  seq PACVCMCTXSCYS/CQ
  UNSURE -5: Xaa = Leu,Arg
MCMQVDLAFSFPPACVCMCTXSCYSCQCE

SEQ ID NO: 2993 - protein, 70 aa, Homo Sapiens
  Pancreas
  SIGNAL -32..-1: Von Heijne matrix; score 3.80; seq IRTATLVISLARG/WQ
MAPGEKESGEGPAKSALRKIRTATLVISLARGWQQWANENSIRQAQEPTGWLPGGTQDSPQAPKPITPRG

SEQ ID NO: 2994 - protein, 52 aa, Homo Sapiens
  liver
  SIGNAL -42..-1: Von Heijne matrix
  score 3.70
  seq PLLHLFYQHLCFP/VP
  UNSURE -33: Xaa =  * ,Leu
MEPKRGRMWXFEIEDSCIYQDIPSFVLLYPLLHLFYQHLCFPVPCTRNPGPG

SEQ ID NO: 2995 - protein, 27 aa, Homo Sapiens
  Lung (cells)
  SIGNAL -17..-1: Von Heijne matrix; score 3.60; seq SVLQRCLFSFVTS/VF
MEFCSVLQRCLFSFVTSVFHMLFPLPG

SEQ ID NO: 2996 - protein, 23 aa, Homo Sapiens
  liver
  SIGNAL -18..-1: Von Heijne matrix; score 3.60; seq IYVLLFFLLMKFS/FD
MAESQIYVLLFFLLMKFSFDTRG

SEQ ID NO: 2997 - protein, 27 aa, Homo Sapiens [sequence omitted]

SEQ ID NO: 2998 - protein, 29 aa, Homo Sapiens
  Large intestine
  SIGNAL -26..-1: Von Heijne matrix; score 3.60; seq KVLMGLLCNQTAA/KR
MGQNNASFHCPCLKVLMGLLCNQTAAKRP

SEQ ID NO: 2999 - protein, 32 aa, Homo Sapiens [sequence omitted]

SEQ ID NO: 3000 - protein, 31 aa, Homo Sapiens
  Thyroid
  SIGNAL -23..-1: Von Heijne matrix; score 3.60; seq WITCPPTFHGCRA/LF
MWLNCGGLQRWITCPPTFHGCRALFPVLDAG

SEQ ID NO: 3001 - protein, 40 aa, Homo Sapiens
  Lung (cells)
  SIGNAL -32..-1: Von Heijne matrix; score 3.60; seq LGVLTFILQRTTC/LN
MWQGCNCSQLSETAVDQEQLGVLTFILQRTTCLNVSAGKR

SEQ ID NO: 3002 - protein, 42 aa, Homo Sapiens [sequence omitted]

SEQ ID NO: 3003 - protein, 111 aa, Homo Sapiens
  Pancreas
  SIGNAL -74..-1: Von Heijne matrix
  score 3.50
  seq ECLNLLLSSGADL/RR
  UNSURE 12: Xaa = Asp,His
  UNSURE 20: Xaa = Asp,Tyr
  UNSURE -67: Xaa = Gly,Arg
  UNSURE -59: Xaa = Leu,Arg
  UNSURE 37: Xaa = Lys,Gln,Arg
MHLAVLFXFSDCCRKXLSSGQLYSIVSSLSNEHVLSAGFDINTPDNLGRTCLHAAASGGNVECLNLLLSSGADLRRRDKFGRTPLXYAAANGSXQCAVTLVTAGAGVNEGX

SEQ ID NO: 3004 - protein, 33 aa, Homo Sapiens [sequence omitted]

SEQ ID NO: 3005 - protein, 57 aa, Homo Sapiens
  Thyroid
  SIGNAL -20..-1: Von Heijne matrix
  score 3.50
  seq KFCLICLLTFIFH/HC
  UNSURE 19: Xaa =  * ,Gln
MKVHMHTKFCLICLLTFIFHHCNHCHEEHDHGPEALHRXHRGMTELEPSKFSKQARG

SEQ ID NO: 3006 - protein, 77 aa, Homo Sapiens
  Lung
  SIGNAL -25..-1: Von Heijne matrix; score 3.50; seq IFLGKSLFSLLEA/MI
MSFNLQSSKKLFIFLGKSLFSLLEAMIFALLPKPRKNVAGEIVLITGAGSGLGRLLALQFARLGSVLVLWDINKEGR

SEQ ID NO: 3007 - protein, 126 aa, Homo Sapiens
  Large intestine
  SIGNAL -26..-1: Von Heijne matrix; score 7.60; seq FLLLVAAPRWVVS/EM
MDLMCRKVKHLLFFLLLVAAPRWVVSEMQIEESGPGLVKPSETLTLTCNVFGGAINTNAYYWAWVRQSPGKGLEWIGSVYYSGSTYYNPSLKSRVTMSMATSRNQFSLQMSSVMATDTAVYYCARQ

SEQ ID NO: 3008 - protein, 63 aa, Homo Sapiens
  Lung (cells)
  SIGNAL -52..-1: Von Heijne matrix
  score 6.60
  seq FFAVLFFLWRSFX/SV
  UNSURE -1: Xaa = Gly,Arg
MELKSPEEEVVAALPEGMRPDSNLYGFPWELVICAAVVGFFAVLFFLWRSFXSVRSRLYVGRG

SEQ ID NO: 3009 - protein, 77 aa, Homo Sapiens
  Thyroid
  SIGNAL -39..-1: Von Heijne matrix
  score 6.60
  seq LALVLAWLSTYVA/DS
  UNSURE 21: Xaa = His,Gln
MELSDVTLIEGVGNEVMVVAGVVVLILALVLAWLSTYVADSGSNQLLGAIVSAGDTSVLXLGHVDHLVAGQGNPERR

SEQ ID NO: 3010 - protein, 67 aa, Homo Sapiens
  Pancreas
  SIGNAL -41..-1: Von Heijne matrix
  score 5.40
  seq RLLYIGFLGYCSG/LI
  UNSURE 24: Xaa = Pro,Thr
MIARRNPEPLRFLPDEARSLPPPKLTDPRLLYIGFLGYCSGLIDNLIRRRPIATAGLHRQLLYIXAG

SEQ ID NO: 3011 - protein, 48 aa, Homo Sapiens
  Thyroid
  SIGNAL -24..-1: Von Heijne matrix; score 5.20; seq VGGLILWLSVGSS/GD
MPPGPWESCFWVGGLILWLSVGSSGDAPPTPQPKCADFQSANLFEGTR

SEQ ID NO: 3012 - protein, 36 aa, Homo Sapiens [sequence omitted]

SEQ ID NO: 3013 - protein, 108 aa, Homo Sapiens
  Lung (cells)
  SIGNAL -46..-1: Von Heijne matrix; score 4.70; seq IICCVFLLLAIVG/YV
MGDERPHYYGKHGTPQKYDPTFKGPIYNRGCTDIICCVFLLLAIVGYVAVGIIAWTHGDPRKVIYPTDSRGEFCGQKGTKNENKPYLFYFNIVKCASPLVLLEFQCPT

SEQ ID NO: 3014 - protein, 81 aa, Homo Sapiens
  Lung (cells)
  SIGNAL -16..-1: Von Heijne matrix; score 4.50; seq RLLLRRFLASVIS/RK
MAQRLLLRRFLASVISRKPSQGQWPPLTSRALQTPQCSPGGLTVTPNPARTIYTTRISLTTFNIQDGPDFQDRVVNSETPA

SEQ ID NO: 3015 - protein, 90 aa, Homo Sapiens
  Lung (cells)
  SIGNAL -23..-1: Von Heijne matrix
  score 4.40
  seq QFILLGTTSVVTA/AL
  UNSURE 42: Xaa = Asp,Asn,Tyr
  UNSURE 67: Xaa = Asp,Glu
MESGGRPSLCQFILLGTTSVVTAALYSVYRQKARVSQELKGAKKVHLGEDLKSILSEAPGKCVPXAVIEGAVRSVKETLNSQFVENCKGX

SEQ ID NO: 3016 - protein, 73 aa, Homo Sapiens
  Liver
  SIGNAL -24..-1: Von Heijne matrix; score 16.40; seq LLLLLLLASLTSG/SV
MALSSQIWAACLLLLLLLASLTSGSVFPQQTGQLAELQPQDRAGARASWMPMFQRRRRRDTHFPICIFCCGPG

SEQ ID NO: 3017 - protein, 79 aa, Homo Sapiens
  Large intestine
  SIGNAL -23..-1: Von Heijne matrix
  score 14.40
  seq LGLLLFLLPGSLG/AE
  UNSURE 46: Xaa =  * ,Ala,Cys,Asp,Glu,Gly,His,Lys,Asn,Pro,Gln,Arg,Ser,Thr,Trp,Tyr
  UNSURE 47: Xaa = Ala,Cys,Asp,Phe,Gly,His,Ile,Leu,Asn,Pro,Arg,Ser,Thr,Val,Tyr
MGVPRPQPWALGLLLFLLPGSLGAESHLSLLYHLTAVSSPAPGTPAFWVSGWLGPQQYLSYNSLRGEAXXVELGSGKTR

SEQ ID NO: 3018 - protein, 51 aa, Homo Sapiens
  Liver
  SIGNAL -18..-1: Von Heijne matrix; score 10.30; seq SLLLSVLLAQVWL/VP
MKVVPSLLLSVLLAQVWLVPGLAPSPQSPETPAPQNQTSRVVQAPREEEEW

SEQ ID NO: 3019 - protein, 195 aa, Homo Sapiens
  Pancreas
  SIGNAL -16..-1: Von Heijne matrix
  score 9.50
  seq ITVLAALLACASS/CG
  UNSURE 145: Xaa = Ala,Gly,Pro,Arg
  UNSURE 155: Xaa = Ala,Pro
  UNSURE 96: Xaa = Arg,Ser,Thr
  UNSURE 53: Xaa = Asp,Glu,Val
  UNSURE 151: Xaa = Asp,Val
  UNSURE 14: Xaa = Glu,Val
  UNSURE 100: Xaa = Leu,Arg
  UNSURE 97: Xaa = Leu,Ser,Trp
  UNSURE 126: Xaa = Leu,Val
  UNSURE 170: Xaa = Phe,Ile
  UNSURE 148: Xaa = Ser,Thr
MLSITVLAALLACASSCGVPSFPPNLSARXVGGEDARPHSWPWQISLQYLKNDTWRHTCGGTLIASNFXLTAAHCISNTRTYRVAVGKNNLEVEDEEGSLFVGVDTIHVHKXXNAXLLRNDIALIKLAEHVELSDTIQVACXPEKDSLLPKDYPCYVSRLXPPXGGXSGGXLNCQLENGSWEVFGXVSFGSRRGC

SEQ ID NO: 3020 - protein, 123 aa, Homo Sapiens
  Pancreas
  SIGNAL -16..-1: Von Heijne matrix
  score 9.50
  seq ITVLAALLACASS/CG
  UNSURE 62: Xaa = Asp,Asn
  UNSURE 24: Xaa = Lys,Asn,Arg,Ser
  UNSURE 85: Xaa = Phe,Tyr
MLGITVLAALLACASSCGVPSFPPNLSARVVGGEDARPHXWPWQISLQYLKNDTWRHTCGGTLIASNFVLTAAHCISXTRTYRVAVGKNNLEVEDEEGSLXVGVDTIHVHRRWNALLLRNDIA

SEQ ID NO: 3021 - protein, 52 aa, Homo Sapiens
  Colon
  SIGNAL -38..-1: Von Heijne matrix; score 8.80; seq LLLPLLSLPVTTP/WT
MAGNGESEPDRLHLLTGHRVKGEFQLLLPLLSLPVTTPWTNPEEGTFSRSHG

SEQ ID NO: 3022 - protein, 90 aa, Homo Sapiens
  Large intestine
  SIGNAL -14..-1: Von Heijne matrix; score 8.70; seq LWWLVLLLLPTLK/SV
MLWWLVLLLLPTLKSVFCSLVTSLYLPNTEDLSLWLWPKPDLHSGTRTEVSTHTVPSKPGTASPCWPLAGAVPSPTVSRLEALTRAVQVA

SEQ ID NO: 3023 - protein, 53 aa, Homo Sapiens
  Liver
  SIGNAL -29..-1: Von Heijne matrix
  score 8.50
  seq LLGLLMAACFTFC/LS
  UNSURE 15: Xaa = Asp,Glu
  UNSURE 17: Xaa = Ser,Thr
MAPQSLPSSRMAPLGMLLGLLMAACFTFCLSHQNLKEYALTNPXKXSTKETEG

SEQ ID NO: 3024 - protein, 70 aa, Homo Sapiens
  Lung
  SIGNAL -23..-1: Von Heijne matrix; score 8.10; seq LLLVTVSSNLAIA/IK
MMLHSALGLCLLLVTVSSNLAIAIKKEKRPPQTLSRGWGDDITWVQTYEEGLFYAQKSKKPLMVIHHLDG

SEQ ID NO: 3025 - protein, 86 aa, Homo Sapiens
  Liver
  SIGNAL -26..-1: Von Heijne matrix
  score 7.60
  seq LITLCLVCIVANA/LL
  UNSURE 48: Xaa = any one of the twenty amino acids
MCTGKCARCVGLSLITLCLVCIVANALLLVPNGETSWTNTNHLSLQVWLMGGFIGGGLMVLCPGIAAVRAGGKXCCGAGCCGNRLR

SEQ ID NO: 3026 - protein, 36 aa, Homo Sapiens
  Lung (cells)
  SIGNAL -23..-1: Von Heijne matrix; score 7.50; seq LVLLLTLPLHLMA/LL
MDILVPLLQLLVLLLTLPLHLMALLGCWQPLCKSFG

SEQ ID NO: 3027 - protein, 23 aa, Homo Sapiens
  Liver
  SIGNAL -15..-1: Von Heijne matrix; score 7.50; seq FLVLFSFFNIALC/AP
MPFLVLFSFFNIALCAPRKFARK

SEQ ID NO: 3028 - protein, 108 aa, Homo Sapiens
  Pancreas
  SIGNAL -19..-1: Von Heijne matrix; score 6.80; seq AIVALAVCAALHA/SE
MQQRGLAIVALAVCAALHASEAILPIASSCCTEVSHHISRRLLERVNMCRIQRADGDCDLAAVILHVKRRRICVSPHNHTVKQWMKVQAAKKNGKGNVCHRKKHHGKR

SEQ ID NO: 3029 - protein, 108 aa, Homo Sapiens
  Lung
  SIGNAL -20..-1: Von Heijne matrix
  score 6.80
  seq GLLWMLFVSELRA/AT
  UNSURE 86: Xaa = Glu,Lys,Gln
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVXDS

SEQ ID NO: 3030 - protein, 64 aa, Homo Sapiens
  Thyroid
  SIGNAL -22..-1: Von Heijne matrix
  score 6.80
  seq VSLVLLMPGPCDG/LF
  UNSURE 38: Xaa =  * ,Cys,Phe,His,Leu,Pro,Gln,Arg,Ser,Trp,Tyr
  UNSURE 10: Xaa = Ala,Cys,Phe,Gly,Leu,Pro,Arg,Ser,Val
  UNSURE 39: Xaa = Gly,Ser
MVGAMWKVIVSLVLLMPGPCDGLFRSLYRSVXMPPKGDSGQPLFLTPYIEAGKIQKGREXXLVG

SEQ ID NO: 3031 - protein, 61 aa, Homo Sapiens
  Lung (cells)
  SIGNAL -40..-1: Von Heijne matrix; score 6.10; seq ICIGILVLPFIRC/CC
MIHLRIIQRCYMAGLENKKNVVFEAKQICIGILVLPFIRCCCLVQITFSLSLHFLIYNMRR

SEQ ID NO: 3032 - protein, 98 aa, Homo Sapiens
  Lung (cells)
  SIGNAL -22..-1: Von Heijne matrix; score 5.90; seq LIYILWQLTGSAA/SG
MAGSPTCLTLIYILWQLTGSAASGPVKELVGSVGGAVTFPLKSKVKQVDSIVWTFNTTPLVTIQPEGGTIIVTQNRNRERVDFPDGGYSLKLSKLKKG

SEQ ID NO: 3033 - protein, 113 aa, Homo Sapiens
  Thyroid
  SIGNAL -59..-1: Von Heijne matrix
  score 5.70
  seq ALLDLCAAPXGWL/QV
  UNSURE -4: Xaa = Gly,Arg
  UNSURE 40: Xaa = Lys,Arg
MGKKGKVGKSRRDKFYHLAKETGYRSRSAFKLIQLNRRFQFLQKARALLDLCAAPXGWLQVAAKFMPVSSLIVGVDLVPIKPLPNVVTLQEDITTERCXQRHWTSASALERKM

SEQ ID NO: 3034 - protein, 75 aa, Homo Sapiens
  liver
  SIGNAL -32..-1: Von Heijne matrix
  score 5.70
  seq FGLVXVGTALALA/RK
  UNSURE 29: Xaa = Ala,Gly
  UNSURE -9: Xaa = Cys,Ser
MPLSDFILALKDNPYFGAGFGLVXVGTALALARKGVQLGLVAFRRHYMITLEVPARDRSYXWLLSWLTRHSTRTG

SEQ ID NO: 3035 - protein, 93 aa, Homo Sapiens
  Large intestine
  SIGNAL -19..-1: Von Heijne matrix
  score 5.60
  seq WVFLVAIIKGVQC/QA
  UNSURE 45: Xaa = Leu,Met
  UNSURE 46: Xaa = Lys,Gln
MEFGLSWVFLVAIIKGVQCQAQLEESGGGLVQPGGSLRLSCRGSGFTLSDHYMSWIRQSPGKGXXWVAYISYSGSTIYYGDSVDGRFTISRDN

SEQ ID NO: 3036 - protein, 44 aa, Homo Sapiens
  Lung (cells)
  SIGNAL -21..-1: Von Heijne matrix
  score 5.30
  seq SLFSSLPIFLTWA/HI
  UNSURE 9: Xaa = Pro,Gln
MILRKRSCSLFSSLPIFLTWAHIKRVPLLXTSLHTAHNGHPHYG

SEQ ID NO: 3037 - protein, 30 aa, Homo Sapiens
  Colon
  SIGNAL -16..-1: Von Heijne matrix; score 5.00; seq GLMFVKLVNPCSG/EG
MKNGLMFVKLVNPCSGEGAIYLFNMCLQQR

SEQ ID NO: 3038 - protein, 39 aa, Homo Sapiens
  Lung (cells)
  SIGNAL -15..-1: Von Heijne matrix; score 4.90; seq AVVFVFSLLDCCA/LI
MEAVVFVFSLLDCCALIFLSVYFIITLSDLECDYINARS

SEQ ID NO: 3039 - protein, 62 aa, Homo Sapiens
  Pancreas
  SIGNAL -56..-1: Von Heijne matrix
  score 4.70
  seq FACVPGASXTTLA/FP
  UNSURE -5: Xaa = Ala,Pro,Ser
MTGFLLPPASRGTRRSCSRSRKRQTRRRRNPSSFVASCPTLLPFACVPGASXTTLAFPPVVL

SEQ ID NO: 3040 - protein, 60 aa, Homo Sapiens
  Colon
  SIGNAL -19..-1: Von Heijne matrix; score 4.50; seq SVPLLTDAATVSG/AE
MCGNTMSVPLLTDAATVSGAERETAAVIFLHGLGDTGHSWADALSTIRLPHVKYICPHAR

SEQ ID NO: 3041 - protein, 61 aa, Homo Sapiens
  Large intestine
  SIGNAL -43..-1: Von Heijne matrix
  score 4.30
  seq SLWRLQWLKDASC/DP
  UNSURE 11: Xaa = Ala,Val
  UNSURE -42: Xaa = Glu,Val
  UNSURE -41: Xaa = Gly,Arg,Trp
  UNSURE 8: Xaa = Ile,Leu
  UNSURE -40: Xaa = Ile,Met
  UNSURE -39: Xaa = Pro,Arg
MXXXXERRTSPHVMADQSSTRNEDFLKKTWSLWRLQWLKDASCDPYPALPXFWXTEAKCES

SEQ ID NO: 3042 - protein, 27 aa, Homo Sapiens
  Pancreas
  SIGNAL -14..-1: Von Heijne matrix
  score 3.80
  seq FLLLNCIVAVSQN/MG
  UNSURE 11: Xaa = Gly,Arg
MFLLLNCIVAVSQNMGIGKNGDLPXPQ

SEQ ID NO: 3043 - protein, 60 aa, Homo Sapiens
  Lung
  SIGNAL -14..-1: Von Heijne matrix
  score 3.80
  seq LLVSAAPLGFGQG/VW
  UNSURE 12: Xaa =  * ,Tyr
MLLVSAAPLGFGQGVWNRASQLQQGXDPLGAGRSWRGLCKLSQALGAGTGSGFHTHTRAP

SEQ ID NO: 3044 - protein, 36 aa, Homo Sapiens
  liver
  SIGNAL -16..-1: Von Heijne matrix; score 3.70; seq IALTLIPSMLSRA/AG
MLRIALTLIPSMLSRAAGWCWYKEPTQQFSYLCLPG

SEQ ID NO: 3045 - protein, 41 aa, Homo Sapiens
  Lung
  SIGNAL -19..-1: Von Heijne matrix
  score 3.70
  seq LPGLRCSVPGVAA/RL
  UNSURE 20: Xaa =  * ,Glu,Lys
  UNSURE 21: Xaa = Ala,Glu
MTLGGRLPGLRCSVPGVAARLSTPPQVRQHVFWAASVCXXT

SEQ ID NO: 3046 - protein, 67 aa, Homo Sapiens
  Liver
  SIGNAL -14..-1: Von Heijne matrix
  score 3.60
  seq AFTLXSLLQAALL/CV
  UNSURE -9: Xaa =  * ,Tyr
  UNSURE 37: Xaa = Glu,Gln
  UNSURE 38: Xaa = Leu,Val
  UNSURE 40: Xaa = Lys,Asn,Arg,Ser,Thr
MAFTLXSLLQAALLCVNAIAVLHEERFLKNIGWGTDQGIGGFGEEPGIKSXXMXLIRSVRTVMRVPL

SEQ ID NO: 3047 - protein, 92 aa, Homo Sapiens
  Pancreas
  SIGNAL -21..-1: Von Heijne matrix
  score 3.50
  seq LKVVFMVFASLXA/WY
  UNSURE -2: Xaa =  * ,Cys,Asp,Glu,Gly,Tyr
  UNSURE 52: Xaa = Ala,Thr
  UNSURE 9,51: Xaa = Asp,Glu
  UNSURE 10: Xaa = Phe,Ile,Leu,Val
MRPLAGGLLKVVFMVFASLXAWYSGYLLAXXIPDAPLSSAAYSIRSIGERPVLKAPVPKRQKCDHWTPCPSXXYAYRLLSGGGRSKYAKICF

SEQ ID NO: 3048 - protein, 58 aa, Homo Sapiens
  Colon
  SIGNAL -22..-1: Von Heijne matrix; score 3.50; seq AAPVAAGLGPVIS/RP
MFEEPEWAEAAPVAAGLGPVISRPPPAASSQNKGSKRRQLLATLRALEAASLSQHPPM

SEQ ID NO: 3049 - protein, 30 aa, Homo Sapiens
  Lung (cells)
  SIGNAL -23..-1: Von Heijne matrix; score 3.50; seq ALYNIIYVCGIQG/IT
MHIYTGIKYIALYNIIYVCGIQGITFMRAR

SEQ ID NO: 3050 - protein, 26 aa, Homo Sapiens
  Heart
  SIGNAL -20..-1: Von Heijne matrix; score 15.80; seq LLLLLLLRHGAQG/KP
MMWRPSVLLLLLLLRHGAQGKPSPDA

SEQ ID NO: 3051 - protein, 40 aa, Homo Sapiens
  kidney
  SIGNAL -25..-1: Von Heijne matrix
  score 14.00
  seq LAMLALLSPLSLA/QY
  UNSURE 8: Xaa =  * ,Asp,Glu,Tyr
  UNSURE 7: Xaa = His,Gln
MERPLCSHLCSCLAMLALLSPLSLAQYDSWPXXPEYFQQP

SEQ ID NO: 3052 - protein, 55 aa, Homo Sapiens
  Dystrophic muscle
  SIGNAL -18..-1: Von Heijne matrix; score 12.30; seq HILFLLLLPVAAA/QT
MIHLGHILFLLLLPVAAAQTTPGERSSLPAFYPGTSGSCSGCGSLSLPLLAGLVA

SEQ ID NO: 3053 - protein, 31 aa, Homo Sapiens
  kidney
  SIGNAL -22..-1: Von Heijne matrix; score 12.20; seq LALALGLAQPASA/RR
MAVKLGTLLLALALGLAQPASARRKLLVFLL

SEQ ID NO: 3054 - protein, 74 aa, Homo Sapiens
  Kidney
  SIGNAL -20..-1: Von Heijne matrix; score 11.90; seq LVLEFLLLSPVEA/QQ
METLGALLVLEFLLLSPVEAQQATEHRLKPWLVGLAAVVGFLFIVYLVLLANRLWCSKARAEDEEETTFRMESG

SEQ ID NO: 3055 - protein, 57 aa, Homo Sapiens
  kidney
  SIGNAL -16..-1: Von Heijne matrix
  score 11.30
  seq PLLLSSLLGGSQA/MD
  UNSURE 24: Xaa = Ala,Ser
MLLPLLLSSLLGGSQAMDGRFWIRVQESVMVPEGLCISVXLLFLLPPTRLDRVYPSR

SEQ ID NO: 3056 - protein, 136 aa, Homo Sapiens
  kidney
  SIGNAL -14..-1: Von Heijne matrix; score 10.70; seq LWLLFFLVTAIHA/EL
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPTR

SEQ ID NO: 3057 - protein, 50 aa, Homo Sapiens
  kidney
  SIGNAL -27..-1: Von Heijne matrix
  score 10.70
  seq LPLLCLFLQGATA/VL
  UNSURE 19: Xaa = His,Gln
MAGSPSRAAGRRLQLPLLCLFLQGATAVLFAVFVRYNHKTDAALWXRKLG

SEQ ID NO: 3058 - protein, 55 aa, Homo Sapiens
  Dystrophic muscle
  SIGNAL -39..-1: Von Heijne matrix
  score 10.60
  seq ALALLLVLPLLWP/CS
  UNSURE 10: Xaa =  * ,Tyr
  UNSURE -15: Xaa = Ala,Thr
MKWPWTCLAILCPGPVLSPPCSGPXLALALLLVLPLLWPCSVFGHALCXPSPARR

SEQ ID NO: 3059 - protein, 108 aa, Homo Sapiens
  kidney
  SIGNAL -23..-1: Von Heijne matrix
  score 10.00
  seq PLLGLLLSLPAGA/DV
  UNSURE 31: Xaa = Gly,Trp
MPSWIGAVILPLLGLLLSLPAGADVKARSCGEVRQAYGAKGFSLADIPYQEIAXEHLRICPQEYTCCTTEMEDKLSQQSKLEFENLVEETSHFVRTTFVSRHKKFDGR

SEQ ID NO: 3060 - protein, 48 aa, Homo Sapiens
  kidney
  SIGNAL -28..-1: Von Heijne matrix
  score 10.00
  seq LWLSLLVPSCLCA/SP
  UNSURE -19: Xaa = Ala,Asp
  UNSURE -15: Xaa = Ala,Ser
  UNSURE -18: Xaa = Asp,Gly,Val
MLLHWVRSQXXSDXKLWLSLLVPSCLCASPWPLPSLPLLLPPSLLSLL

SEQ ID NO: 3061 - protein, 56 aa, Homo Sapiens
  kidney
  SIGNAL -34..-1: Von Heijne matrix
  score 9.60
  seq LLLFSLLVSPPTC/KV
  UNSURE 16: Xaa = His,Leu,Pro
MKYLRHRRPNATLILAIGAFTLLLFSLLVSPPTCKVQEQPPAIPEALAWXTPPTRW

SEQ ID NO: 3062 - protein, 127 aa, Homo Sapiens
  kidney
  SIGNAL -35..-1: Von Heijne matrix
  score 9.50
  seq AMWWLLLWGVLQA/WP
  UNSURE 64: Xaa =  * ,Cys,Tyr
  UNSURE 3: Xaa = Asn,Thr
  UNSURE 65: Xaa = Asp,His,Tyr
MPGPRVWGKYLWRSPHSKGCPGAMWWLLLWGVLQAWPXPGLRPLGPRATPAADIPRVPRAVWQRPREQHGHQGSRGLCCEARLPGLRPGAVPGLCRGLXXNLIRRFGSKPVLWSARLPSGQAPWSEG

SEQ ID NO: 3063 - protein, 71 aa, Homo Sapiens
  Dystrophic muscle
  SIGNAL -37..-1: Von Heijne matrix
  score 9.20
  seq LLAVLLASWRLWA/IK
  UNSURE 27: Xaa = Ser,Thr
MCGPAMFPAGPPWPRVRVVQVLWALLAVLLASWRLWAIKDFQECTWQVVLNEFKRVGESGVSDXSLSKSPG

SEQ ID NO: 3064 - protein, 63 aa, Homo Sapiens
  Muscle
  SIGNAL -55..-1: Von Heijne matrix
  score 9.20
  seq SLLLLSTALNILA/CQ
  UNSURE -39: Xaa = Pro,Thr
MHRRKLPLTNKRQLQKXLSKFIFSDELFRNILFSLRTLRMILSLLLLSTALNILACQINEELG

SEQ ID NO: 3065 - protein, 23 aa, Homo Sapiens
  Heart
  SIGNAL -17..-1: Von Heijne matrix
  score 8.30
  seq VSALLMAWFGVLS/CV
  UNSURE 5: Xaa = Asp,Glu
  UNSURE 6: Xaa = Leu,Met,Pro,Ser,Thr
MKLWVSALLMAWFGVLSCVQAXX

SEQ ID NO: 3066 - protein, 50 aa, Homo Sapiens
  kidney
  SIGNAL -19..-1: Von Heijne matrix; score 8.10; seq LCLVCLLVHTAFR/VV
MQLPLALCLVCLLVHTAFRVVEGQGWQAFKNDATEIIPELGEYPEPPPER

SEQ ID NO: 3067 - protein, 36 aa, Homo Sapiens
  Muscle
  SIGNAL -31..-1: Von Heijne matrix
  score 8.00
  seq ILLCSVAVXLSPS/EP
  UNSURE -5: Xaa =  * ,Cys,Ser
  UNSURE -25: Xaa = Asp,Tyr
  UNSURE -26: Xaa = His,Gln
MLCIHXXRIIQDSFIALKILLCSVAVXLSPSEPLAP

SEQ ID NO: 3068 - protein, 71 aa, Homo Sapiens
  kidney
  SIGNAL -38..-1: Von Heijne matrix
  score 7.90
  seq LPFLSLFWPWAPG/AV
  UNSURE 15: Xaa =  * ,Ala,Gly,Ser
MGGFFPPTEVREVCANQGAAHNRDRLPFLSLFWPWAPGAVSVGQARYRTPTTXAPSASVPWPRAGTCRTPT

SEQ ID NO: 3069 - protein, 37 aa, Homo Sapiens
  Heart
  SIGNAL -30..-1: Von Heijne matrix; score 7.90; seq HLWILLLFSFCWM/SR
MKLFYNQLVSETKHDFAHLWILLLFSFCWMSRSFFFF

SEQ ID NO: 3070 - protein, 23 aa, Homo Sapiens [sequence omitted]

SEQ ID NO: 3071 - protein, 115 aa, Homo Sapiens
  kidney
  SIGNAL -68..-1: Von Heijne matrix; score 7.90; seq LLCSALAWQQSLS/GK
MSSMWSEYTIGGVKIYFPYKAYPSQLAMMNSILRGLNSKQHCLLESPTGSGKSLALLCSALAWQQSLSGKPADEGVSEKAEVQLSCCCACHSKDFTNNDMNQGTSRHFNYPSTPR

SEQ ID NO: 3072 - protein, 37 aa, Homo Sapiens
  kidney
  SIGNAL -28..-1: Von Heijne matrix; score 7.80; seq FVRFLGFVSCLQS/DP
MALFLELFLNSYSLLFVRFLGFVSCLQSDPICSFFFF

SEQ ID NO: 3073 - protein, 72 aa, Homo Sapiens
  kidney
  SIGNAL -24..-1: Von Heijne matrix
  score 7.80
  seq LMAGSSLSAGVSG/ED
  UNSURE 12: Xaa = Ala,Pro
MNEDEKEMKEILMAGSSLSAGVSGEDKTEILNPTPXMAKSLTIDCLELALPPELAFQLNELFGPVGIDSGSL

SEQ ID NO: 3074 - protein, 27 aa, Homo Sapiens
  Heart
  SIGNAL -21..-1: Von Heijne matrix
  score 7.80
  seq IIPLIXXLSLCLC/LW
  UNSURE -8: Xaa = Ala,Cys,Asp,Phe,Gly,His,Ile,Leu,Asn,Pro,Arg,Ser,Thr,Val,Tyr
  UNSURE -7: Xaa = Phe,Leu
MGSFLLGGIIPLIXXLSLCLCLWWRII

SEQ ID NO: 3075 - protein, 41 aa, Homo Sapiens
  kidney
  SIGNAL -31..-1: Von Heijne matrix
  score 7.80
  seq VCLLCSGCSCAWS/VG
  UNSURE 5: Xaa = Leu,Trp
MLQVATTNYLELAREVKPVCLLCSGCSCAWSVGCVXESESE

SEQ ID NO: 3076 - protein, 22 aa, Homo Sapiens
  kidney
  SIGNAL -18..-1: Von Heijne matrix; score 7.70; seq PFFLALCFPKSTS/QP
MFCLAPFFLALCFPKSTSQPQR

SEQ ID NO: 3077 - protein, 72 aa, Homo Sapiens [sequence omitted]

SEQ ID NO: 3078 - protein, 50 aa, Homo Sapiens [sequence omitted]

SEQ ID NO: 3079 - protein, 62 aa, Homo Sapiens
  Dystrophic muscle
  SIGNAL -19..-1: Von Heijne matrix
  score 7.20
  seq FIXFPFLFPFSFS/QT
  UNSURE -14,-11: Xaa = Phe,Ser
MCLLFXFIXFPFLFPFSFSQTFSFSQHWNTGGSHPEELERPGAHPRLKARPQPPLFHPFISS

SEQ ID NO: 3080 - protein, 66 aa, Homo Sapiens
  Dystrophic muscle
  SIGNAL -25..-1: Von Heijne matrix
  score 7.10
  seq LLVASGXAEGVSA/QS
  UNSURE -7: Xaa = Ala,Asp
  UNSURE -15: Xaa = Ala,Asp,Val
  UNSURE 13: Xaa = Ala,Gly
  UNSURE 33: Xaa = Asp,Glu
  UNSURE 5: Xaa = His,Gln
  UNSURE -20: Xaa = Ile,Leu
  UNSURE 20: Xaa = Ile,Thr
MASERXPNRPXCLLVASGXAEGVSAQSFLXCFTMASTXFNLQVAXPGGKAMEFVDVTXSNARWVQD

SEQ ID NO: 3081 - protein, 56 aa, Homo Sapiens [sequence omitted]

SEQ ID NO: 3082 - protein, 109 aa, Homo Sapiens
  kidney
  SIGNAL -25..-1: Von Heijne matrix
  score 7.10
  seq LLLXLXLLLIALE/IM
  UNSURE -10: Xaa = Cys,Phe,Tyr
  UNSURE -8: Xaa = Leu,Gln
MRRISLTSSPVRLLLXLXLLLIALEIMVGGHSLCFNFTIKSLSRPGQPWCEAHVFLNKNLFLQYNSDNNMVKPLGLLGKKVYATSTWGELTQTLGEVGRDLRMLLCDIK

SEQ ID NO: 3083 - protein, 18 aa, Homo Sapiens
  kidney
  SIGNAL -14..-1: Von Heijne matrix
  score 7.00
  seq TFLLLLFXNAGRS/LR
  UNSURE -6: Xaa = Phe,Val
MTFLLLLFXNAGRSLRMC

SEQ ID NO: 3084 - protein, 38 aa, Homo Sapiens
  Dystrophic muscle
  SIGNAL -26..-1: Von Heijne matrix; score 7.00; seq EMFLVLLVTGVHS/NK
MRTVVLTMKASVIEMFLVLLVTGVHSNKETAKKIKRPG

SEQ ID NO: 3085 - protein, 44 aa, Homo Sapiens [sequence omitted]

SEQ ID NO: 3086 - protein, 28 aa, Homo Sapiens
  kidney
  SIGNAL -25..-1: Von Heijne matrix; score 6.90; seq IPLLLLFFHLSFL/NS
MYLFCLFSVSKTIPLLLLFFHLSFLNSL

SEQ ID NO: 3087 - protein, 43 aa, Homo Sapiens
  kidney
  SIGNAL -16..-1: Von Heijne matrix; score 6.90; seq CLLILKFLSPAET/SI
MIVCLLILKFLSPAETSILSSIATYGAFYFIVPLEVSQILQTQ

SEQ ID NO: 3088 - protein, 32 aa, Homo Sapiens
  kidney
  SIGNAL -25..-1: Von Heijne matrix; score 6.70; seq LILCFLFILHTHT/HT
MDKSIKSSIIWSLILCFLFILHTHTHTHTHTH

SEQ ID NO: 3089 - protein, 41 aa, Homo Sapiens
  kidney
  SIGNAL -36..-1: Von Heijne matrix
  score 6.70
  seq IFDLLLLLXXSNQ/LP
  UNSURE -5: Xaa = Asp,Glu,Lys,Asn
  UNSURE -4: Xaa = Ile,Leu
MFFIFINGFTLLLMTLAMKPRHPIFDLLLLLXXSNQLPVTG

SEQ ID NO: 3090 - protein, 71 aa, Homo Sapiens
  kidney
  SIGNAL -60..-1: Von Heijne matrix; score 6.70; seq LWPFLTWINPALS/IC
MCPSLEEAPSVKGTLPCSGQQQPFPFGASNIPLLLGRSRKVARGAPVLWPFLTWINPALSICDPLGSCGWQ

SEQ ID NO: 3091 - protein, 38 aa, Homo Sapiens
  kidney
  SIGNAL -17..-1: Von Heijne matrix; score 6.60; seq LLSALWFCHPCCL/CC
MLQDLLSALWFCHPCCLCCGLCWLGVDAGCSQGGSGCP

SEQ ID NO: 3092 - protein, 58 aa, Homo Sapiens [sequence omitted]

SEQ ID NO: 3093 - protein, 33 aa, Homo Sapiens [sequence omitted]

SEQ ID NO: 3094 - protein, 58 aa, Homo Sapiens
  Muscle
  SIGNAL -25..-1: Von Heijne matrix
  score 6.50
  seq GLAMLHVTRGVXG/SR
  UNSURE -2,6: Xaa =  * ,Trp
  UNSURE 28: Xaa = Asp,Glu
  UNSURE 8,22: Xaa = Leu,Met
  UNSURE 31: Xaa = Lys,Asn
  UNSURE 7: Xaa = Pro,Ser
  UNSURE 15: Xaa = Pro,Thr
MTVELWLRLRGKGLAMLHVTRGVXGSRVRVXXXLPALLGXPRALSSXAAKMGXYRXMW

SEQ ID NO: 3095 - protein, 40 aa, Homo Sapiens [sequence omitted]

SEQ ID NO: 3096 - protein, 51 aa, Homo Sapiens
  Muscle
  SIGNAL -20..-1: Von Heijne matrix
  score 6.40
  seq FALLFLFLVPVPG/HG
  UNSURE 12: Xaa =  * ,Tyr
MRIHYLLFALLFLFLVPVPGHGGIINTLQKYXLQSQRRPVCCAQLPSKGER

SEQ ID NO: 3097 - protein, 53 aa, Homo Sapiens
  kidney
  SIGNAL -13..-1: Von Heijne matrix
  score 6.40
  seq MCLLTALVTQVIS/LR
  UNSURE 18: Xaa = Cys,Gly,Arg,Ser
MCLLTALVTQVISLRKNAERTCLCKRRWPWXPSPRIYCSSTPCDSKFPTVYSS

SEQ ID NO: 3098 - protein, 27 aa, Homo Sapiens [sequence omitted]

SEQ ID NO: 3099 - protein, 91 aa, Homo Sapiens
  kidney
  SIGNAL -38..-1: Von Heijne matrix
  score 6.30
  seq PCVSLLWAPRXFA/SS
  UNSURE -3: Xaa = Ala,Gly
  UNSURE 12: Xaa = Cys,Gly
  UNSURE 11: Xaa = His,Gln
MNHLMPLTVLHSVLEMLRTPRTPPWPCVSLLWAPRXFASSCSQAFTTLXXNCLLTNPSPTLDCDLPEGSEILNSSLYPHCLLSAWNTRHST

SEQ ID NO: 3100 - protein, 42 aa, Homo Sapiens
  kidney
  SIGNAL -24..-1: Von Heijne matrix
  score 6.30
  seq SLLXLRASQLSEG/DT
  UNSURE 6: Xaa =  * ,Ser
  UNSURE 3: Xaa =  * ,Trp
  UNSURE 9: Xaa = Cys,Asp,Gly,His,Arg,Tyr
  UNSURE -10: Xaa = Cys,Gly
  UNSURE 4: Xaa = Leu,Met,Val
  UNSURE 5: Xaa = Lys,Asn
  UNSURE 11: Xaa = Met,Val
MGHVVFGDIKNSLLXLRASQLSEGDTXXXXCPXMXRGKHISY

SEQ ID NO: 3101 - protein, 98 aa, Homo Sapiens
  Heart
  SIGNAL -81..-1: Von Heijne matrix
  score 6.30
  seq FLSLLXSVSETPG/SL
  UNSURE -8: Xaa = Cys,Phe,Tyr
  UNSURE 4: Xaa = Gly,Arg
MAGGRRDYSQLFGRGPGRLSRARASVVRWSPRATACPAPPSLPDLKRQELVSRIECGCRGPVGATADFFLSLLXSVSETPGSLRXNDLFFVSQLIWGR

SEQ ID NO: 3102 - protein, 22 aa, Homo Sapiens
  kidney
  SIGNAL -19..-1: Von Heijne matrix
  score 6.10
  seq LWCFHSFISFSLS/SS
  UNSURE -16: Xaa = His,Leu,Pro,Arg
MFWXGSLWCFHSFISFSLSSSR

SEQ ID NO: 3103 - protein, 78 aa, Homo Sapiens
  kidney
  SIGNAL -36..-1: Von Heijne matrix
  score 6.00
  seq FLLTFFSYSLLHA/SR
  UNSURE 35: Xaa = Asp,Asn
  UNSURE -19: Xaa = Asp,His,Tyr
  UNSURE 6: Xaa = Gly,Ser
  UNSURE -28: Xaa = Ile,Arg,Thr
  UNSURE -20: Xaa = Ile,Met,Arg,Ser
MAWPNVFQXGSLLSQFXXHHVVVFLLTFFSYSLLHASRKTFXNVKVSISEQWTPSAFNTSVELPVEIWSSXHLFPSAE

SEQ ID NO: 3104 - protein, 29 aa, Homo Sapiens
  kidney
  SIGNAL -19..-1: Von Heijne matrix
  score 6.00
  seq WILAVGLSLPSSS/XI
  UNSURE 1: Xaa = Pro,Thr
MILRNLWILAVGLSLPSSSXIKFHFSLYS

SEQ ID NO: 3105 - protein, 41 aa, Homo Sapiens
  kidney
  SIGNAL -35..-1: Von Heijne matrix; score 5.90; seq LCGLLHLWLKVFS/LK
MLTVNDVRFYRNVRSNHFPFVRLCGLLHLWLKVFSLKQLKK

SEQ ID NO: 3106 - protein, 54 aa, Homo Sapiens
  kidney
  SIGNAL -23..-1: Von Heijne matrix
  score 5.90
  seq LFLNLCILAXPFS/KQ
  UNSURE -4: Xaa =  * ,Cys,Trp
  UNSURE 23: Xaa = Arg,Ser
MNLKPGLPCNLFLNLCILAXPFSKQIIELLEYVSYHPCVLVYSEYXNISIVYTL

SEQ ID NO: 3107 - protein, 101 aa, Homo Sapiens
  kidney
  SIGNAL -40..-1: Von Heijne matrix
  score 5.90
  seq VVLAWGLLNVSMA/GM
  UNSURE 26: Xaa = Ile,Asn,Ser
MMQGEAHPSASLIDRTIKMRKETEARKVVLAWGLLNVSMAGMIYTEMTGKLISSYYNVTYWPLWYXELALASLFSLNALFDFWRYFKYTVAPTSLVVSPGR

SEQ ID NO: 3108 - protein, 58 aa, Homo Sapiens
  kidney
  SIGNAL -19..-1: Von Heijne matrix
  score 5.90
  seq PXXLLILAHITQS/CP
  UNSURE -12: Xaa =  * ,Cys,Tyr
  UNSURE -11: Xaa = Met,Val
MMNQTHPXXLLILAHITQSCPWAHVGAAPSALLIHRWELRGCSYLKLFLVMVLIFEML

SEQ ID NO: 3109 - protein, 107 aa, Homo Sapiens
  kidney
  SIGNAL -20..-1: Von Heijne matrix
  score 5.80
  seq GLVLLLSLAEILF/KI
  UNSURE 86: Xaa = His,Gln
MGLPERRGLVLLLSLAEILFKIMILEGGGVMNLNPGNNLLHQPPAWTDSYSTCNVSSGFFGGQWHEIHPQYWTKYQVWEWLQHLLDTNQLDANCIPFQEFDINGEXR

SEQ ID NO: 3110 - protein, 35 aa, Homo Sapiens
  kidney
  SIGNAL -28..-1: Von Heijne matrix; score 5.80; seq LCWALLYNCFSSS/CV
MWGLEEDRSYQGLRPLCWALLYNCFSSSCVPVALV

SEQ ID NO: 3111 - protein, 91 aa, Homo Sapiens
  kidney
  SIGNAL -85..-1: Von Heijne matrix
  score 5.70
  seq ALLASLGIAFSRS/RA
  UNSURE -55: Xaa =  * ,Cys,Trp
  UNSURE -54: Xaa = Ala,Pro,Ser,Thr
MLCRDGSACVPRSRRLPLPAAVRAHGPMADXXDSARGCVVFEDVFVYFSREEWELLDDAQRLLYHDVMLENFALLASLGIAFSRSRAVMKL

SEQ ID NO: 3112 - protein, 67 aa, Homo Sapiens
  kidney
  SIGNAL -56..-1: Von Heijne matrix; score 5.70; seq FLCFLNLTSHLSG/LD
MLITRLQSGIDFAIQLDESTDIGSCTTLLVYVRYAWQDDFLEDFLCFLNLTSHLSGLDIFTELERRG

SEQ ID NO: 3113 - protein, 64 aa, Homo Sapiens
  kidney
  SIGNAL -38..-1: Von Heijne matrix
  score 5.70
  seq LAFLSCLAFLVLD/TQ
  UNSURE 20: Xaa = Cys,Phe,Ile,Leu,Arg,Ser
MESPQLHCILNSNSVACSFAVGAGFLAFLSCLAFLVLDTQETRIAGTRFKTAFQLLDXILAVLW

SEQ ID NO: 3114 - protein, 30 aa, Homo Sapiens [sequence omitted]

SEQ ID NO: 3115 - protein, 26 aa, Homo Sapiens
  kidney
  SIGNAL -24..-1: Von Heijne matrix
  score 5.60
  seq FFFFLFLLPPXPP/TG
  UNSURE -3: Xaa = Ala,Thr
MVELKQLGPRSFFFFLFLLPPXPPTG

SEQ ID NO: 3116 - protein, 45 aa, Homo Sapiens
  Heart
  SIGNAL -26..-1: Von Heijne matrix; score 5.50; seq LILPALFFFPLHC/TF
MPYVTIPYIIVYSLILPALFFFPLHCTFHGLTYYISCVCSLSLPT

SEQ ID NO: 3117 - protein, 27 aa, Homo Sapiens [sequence omitted]

SEQ ID NO: 3118 - protein, 23 aa, Homo Sapiens
  kidney
  SIGNAL -21..-1: Von Heijne matrix; score 5.50; seq EFLFLGFPSNSWP/HR
MLQIPERREFLFLGFPSNSWPHR

SEQ ID NO: 3119 - protein, 39 aa, Homo Sapiens [sequence omitted]

SEQ ID NO: 3120 - protein, 27 aa, Homo Sapiens [sequence omitted]

SEQ ID NO: 3121 - protein, 32 aa, Homo Sapiens
  kidney
  SIGNAL -28..-1: Von Heijne matrix; score 5.40; seq PLSLALQSSCCLC/LT
MVDRDENILLKQIYSPLSLALQSSCCLCLTSC

SEQ ID NO: 3122 - protein, 33 aa, Homo Sapiens
  kidney
  SIGNAL -20..-1: Von Heijne matrix; score 5.40; seq VSVSLCVCDCVRG/ST
MKVKPPFVSVSLCVCDCVRGSTLTWNRLLRVGG

SEQ ID NO: 3123 - protein, 100 aa, Homo Sapiens
  kidney
  SIGNAL -39..-1: Von Heijne matrix
  score 5.40
  seq ILLTSCFYTLVSS/TF
  UNSURE 32: Xaa =  * ,Lys
  UNSURE 51: Xaa = Cys,Gly
  UNSURE 46: Xaa = Leu,Arg
MISSCGVKYLFSHASLFFMVGSTGSLILLTSCFYTLVSSTFLQKLSSLLLILFTETSVLMLKTFVANSCCXLWSHNCINFFKKVXPSYCXSSLLFLAVPR

SEQ ID NO: 3124 - protein, 25 aa, Homo Sapiens [sequence omitted]

SEQ ID NO: 3125 - protein, 48 aa, Homo Sapiens
  kidney
  SIGNAL -33..-1: Von Heijne matrix; score 5.40; seq LAYFLCCQGVIFG/SL
MDALERGSLRNEQALVIYAGLAYFLCCQGVIFGSLPSNAGAGPLGWSS

SEQ ID NO: 3126 - protein, 44 aa, Homo Sapiens
  Muscle
  SIGNAL -39..-1: Von Heijne matrix; score 5.30; seq SLWFLPLPTHVYT/HT
MEYLFQQPGHSRGEARAAAASLETLSSLWFLPLPTHVYTHTHAN

SEQ ID NO: 3127 - protein, 35 aa, Homo Sapiens
  Dystrophic muscle
  SIGNAL -15..-1: Von Heijne matrix; score 5.30; seq SSMLITILSFIFA/LG
MVSSMLITILSFIFALGYHTASYPVSLHPLSFFLH

SEQ ID NO: 3128 - protein, 30 aa, Homo Sapiens
  kidney
  SIGNAL -18..-1: Von Heijne matrix
  score 5.30
  seq MNLVSALASSAXG/QR
  UNSURE -2: Xaa = Ala,Thr
MPLFTMNLVSALASSAXGQRGAGPALWHLC

SEQ ID NO: 3129 - protein, 41 aa, Homo Sapiens [sequence omitted]

SEQ ID NO: 3130 - protein, 66 aa, Homo Sapiens
  kidney
  SIGNAL -53..-1: Von Heijne matrix; score 5.20; seq SFLLLQLIHEDKA/IQ
MKIPVWHKTCFLKSESFSPDNLSVSLPCRPSQVPSQGQGKSFLLLQLIHEDKAIQNEAIFQPSLQL

SEQ ID NO: 3131 - protein, 30 aa, Homo Sapiens
  kidney
  SIGNAL -19..-1: Von Heijne matrix
  score 5.20
  seq FGCTFVAFXPAFA/LS
  UNSURE -5: Xaa = Cys,Gly,Ser
MGAAVFFGCTFVAFXPAFALSLITVAGDRG

SEQ ID NO: 3132 - protein, 93 aa, Homo Sapiens
  kidney
  SIGNAL -34..-1: Von Heijne matrix
  score 5.20
  seq LWSSCWLAPLADG/ML
  UNSURE 28: Xaa =  * ,Trp
  UNSURE 11: Xaa = Gly,Arg,Trp
  UNSURE 55: Xaa = His,Arg
  UNSURE 36: Xaa = Ile,Arg,Ser
  UNSURE 37: Xaa = Ile,Leu
  UNSURE 8: Xaa = Pro,Gln,Arg
MVGGLDPPGRRRFQKGFDWRNLWSSCWLAPLADGMLRYMGQXQRXASNPEGSTLEARPPAPXASVSPSVXXPHRPWAAKMETVSPATSXIAGG

SEQ ID NO: 3133 - protein, 23 aa, Homo Sapiens [sequence omitted]

SEQ ID NO: 3134 - protein, 23 aa, Homo Sapiens
  kidney
  SIGNAL -15..-1: Von Heijne matrix
  score 5.10
  seq VTQLLPFSSPDSA/GP
  UNSURE -14: Xaa =  * ,Ser
MXVTQLLPFSSPDSAGPFLSPFS

SEQ ID NO: 3135 - protein, 72 aa, Homo Sapiens
  Dystrophic muscle
  SIGNAL -34..-1: Von Heijne matrix; score 5.10; seq SFHFLPWALGAMA/SS
MGKAWQEMRVEWGADKGNVRSSFHFLPWALGAMASSEQGKERSNLCFRKTPLAITGRGIARRPGGGWMGMWV

SEQ ID NO: 3136 - protein, 55 aa, Homo Sapiens
  Dystrophic muscle
  SIGNAL -47..-1: Von Heijne matrix; score 5.10; seq VIRLSQFLLKCWP/RT
MKVMMRKRKKKDQCLPGICRSLKRRKSPRSPGMKVIRLSQFLLKCWPRTSLTAAT

SEQ ID NO: 3137 - protein, 54 aa, Homo Sapiens
  kidney
  SIGNAL -36..-1: Von Heijne matrix
  score 5.00
  seq SFSIXTLLWGLNC/KR
  UNSURE -14: Xaa =  * ,Cys,Phe,Ile,Lys,Leu,Met,Asn,Arg,Ser,Thr,Trp,Tyr
  UNSURE -9: Xaa =  * ,Cys,Phe,Leu,Trp
  UNSURE 12: Xaa = Ala,Gly
MTFSFFCFFPGFKPLLFHYFLFXSFSIXTLLWGLNCKRSWNINLRIVXSYSSGY

SEQ ID NO: 3138 - protein, 65 aa, Homo Sapiens
  kidney
  SIGNAL -41..-1: Von Heijne matrix; score 5.00; seq RLLLILSGCLVYG/TA
MAGGMKVAVSPAVGPGPWGSGVGGGGTVRLLLILSGCLVYGTAETDVNVVMLQESQVCEKRASLG

SEQ ID NO: 3139 - protein, 61 aa, Homo Sapiens
  Muscle
  SIGNAL -32..-1: Von Heijne matrix; score 5.00; seq PLLSCSCPPPLLG/EG
MVEMTGVWQCQAEAVKGLPPLLSCSCPPPLLGEGHAQASPLAQEEDKKHTEQTQATSPTQP

SEQ ID NO: 3140 - protein, 33 aa, Homo Sapiens
  kidney
  SIGNAL -21..-1: Von Heijne matrix
  score 5.00
  seq AGLLPLLLGNAPG/ES
  UNSURE 8: Xaa = Asp,His
MQITPGSAAGLLPLLLGNAPGESVGGRCXPGCW

SEQ ID NO: 3141 - protein, 33 aa, Homo Sapiens [sequence omitted]

SEQ ID NO: 3142 - protein, 58 aa, Homo Sapiens [sequence omitted]

SEQ ID NO: 3143 - protein, 24 aa, Homo Sapiens
  Kidney
  SIGNAL -16..-1: Von Heijne matrix; score 4.90; seq RFTLLPLVLHSQS/SC
MKLRFTLLPLVLHSQSSCVFWKAG

SEQ ID NO: 3144 - protein, 51 aa, Homo Sapiens [sequence omitted]

SEQ ID NO: 3145 - protein, 46 aa, Homo Sapiens
  Heart
  SIGNAL -27..-1: Von Heijne matrix
  score 4.90
  seq CLLSYIALGAIHA/KI
  UNSURE 14: Xaa = Asp,Gly,Asn,Ser
MNRVPADSPNMCLICLLSYIALGAIHAKICRRAFQEEGRAXAKTGV

SEQ ID NO: 3146 - protein, 43 aa, Homo Sapiens
  kidney
  SIGNAL -15..-1: Von Heijne matrix; score 4.80; seq LFLNLPLVIGTIP/LH
MDLFLNLPLVIGTIPLHPFGSRTSSVSSQCSMNMNWLSLSLPE

SEQ ID NO: 3147 - protein, 114 aa, Homo Sapiens
  kidney
  SIGNAL -73..-1: Von Heijne matrix
  score 4.80
  seq VIRSTLVLSQCLC/SR
  UNSURE 18: Xaa = Ala,Asp
  UNSURE -72: Xaa = Ala,Glu
  UNSURE -16: Xaa = Ala,Pro
  UNSURE -53: Xaa = Arg,Ser
  UNSURE -37,3: Xaa = His,Asn
  UNSURE -30: Xaa = Ile,Asn
  UNSURE -38: Xaa = Ile,Met
  UNSURE -51: Xaa = Leu,Met
  UNSURE 39: Xaa = Lys,Gln
  UNSURE -21: Xaa = Pro,Ser
MXKNHRNKKSIHFPLCTIPSXMXKSCTLPLQRTWDXXPSFVHWXQARLQSPPXSHLVXLSVIRSTLVLSQCLCSRXPYFSAMMTPKCKSIXAGNSGMPKRNCKVLPSSEKMXVH

SEQ ID NO: 3148 - protein, 18 aa, Homo Sapiens
  kidney
  SIGNAL -14..-1: Von Heijne matrix; score 4.80; seq SFIALVYSSLSFQ/KV
MSFIALVYSSLSFQKVPG

SEQ ID NO: 3149 - protein, 24 aa, Homo Sapiens
  kidney
  SIGNAL -22..-1: Von Heijne matrix
  score 4.70
  seq IVLFLNSXFPIIC/SR
  UNSURE -6: Xaa = Asp,Ile,Asn,Val
MVFDTLKSRIVLFLNSXFPIICSR

SEQ ID NO: 3150 - protein, 69 aa, Homo Sapiens [sequence omitted]

SEQ ID NO: 3151 - protein, 99 aa, Homo Sapiens
  kidney
  SIGNAL -17..-1: Von Heijne matrix
  score 4.70
  seq MLFFLGALCRESG/VP
  UNSURE 43: Xaa = Ala,Cys,Asp,Phe,Gly,His,Ile,Leu,Asn,Pro,Arg,Ser,Thr,Val,Tyr
  UNSURE 69: Xaa = Lys,Arg
MDDLMLFFLGALCRESGVPSLGKQERMRAYAAEMPPLLPSPCPPPSHLPKPASPCPYPLXLLTFPVGVPHLPGTRLQCQGLGHSLXRAERGVGGGVSPG

SEQ ID NO: 3152 - protein, 71 aa, Homo Sapiens
  kidney
  SIGNAL -25..-1: Von Heijne matrix; score 4.60; seq LPTLLLLPVGAPG/KK
MVLGALNLPSQELPTLLLLPVGAPGKKKGMEGKTPLDLFAHFGPEPGDHSDPLPPSAPSPTREGALTPPPG

SEQ ID NO: 3153 - protein, 34 aa, Homo Sapiens
  kidney
  SIGNAL -19..-1: Von Heijne matrix; score 4.60; seq QTFVSFLSIPVLG/LV
MLVSKIQTFVSFLSIPVLGLVPDHILQLITEKET

SEQ ID NO: 3154 - protein, 39 aa, Homo Sapiens [sequence omitted]

SEQ ID NO: 3155 - protein, 95 aa, Homo Sapiens [sequence omitted]

SEQ ID NO: 3156 - protein, 33 aa, Homo Sapiens [sequence omitted]

SEQ ID NO: 3157 - protein, 29 aa, Homo Sapiens
  kidney
  SIGNAL -24..-1: Von Heijne matrix
  score 4.60
  seq IFTALFLXLHSVA/IN
  UNSURE -18: Xaa = His,Pro,Gln,Arg
  UNSURE -6: Xaa = Leu,Met
MVSCDVXSYVIIFTALFLXLHSVAINEEF

SEQ ID NO: 3158 - protein, 27 aa, Homo Sapiens [sequence omitted]

SEQ ID NO: 3159 - protein, 101 aa, Homo Sapiens
  kidney
  SIGNAL -33..-1: Von Heijne matrix
  score 4.50
  seq LASLFGLDQXAXG/HG
  UNSURE 61: Xaa = Ala,Gly
  UNSURE -2: Xaa = Ala,Gly,Pro,Arg
  UNSURE 35: Xaa = Ala,Gly,Ser,Thr
  UNSURE 28: Xaa = Ala,Thr
  UNSURE -4: Xaa = Ala,Val
  UNSURE 54: Xaa = Asp,Asn
  UNSURE 56: Xaa = Gln,Arg
MFGAGDEDDTDFLSPSGGARLASLFGLDQXAXGHGNEFFQYTAPKQPKKGQGTAATGNQAXPKTAPAXMSTPTILVATAVHAYRYTXGXYVKQXNLVLQFW

SEQ ID NO: 3160 - protein, 62 aa, Homo Sapiens
  kidney
  SIGNAL -28..-1: Von Heijne matrix
  score 4.50
  seq RFLSLSAADGXDX/SX
  UNSURE -1: Xaa = Ala,Gly
  UNSURE 2: Xaa = His,Gln
  UNSURE -3: Xaa = Ser,Thr
MVLTLGESWPVLVGRRFLSLSAADGXDXSXDSWDVERVAEWPWLSGTIRAVSHTDVTKKDLK

SEQ ID NO: 3161 - protein, 23 aa, Homo Sapiens
  kidney
  SIGNAL -17..-1: Von Heijne matrix; score 4.40; seq LTSVFQAMIWSQG/VS
MVIELTSVFQAMIWSQGVSDSSK

SEQ ID NO: 3162 - protein, 68 aa, Homo Sapiens
  kidney
  SIGNAL -50..-1: Von Heijne matrix
  score 4.40
  seq ILFLFYFPAAYYA/SR
  UNSURE -18: Xaa =  * ,Leu,Ser,Trp
  UNSURE -17: Xaa = Ala,Pro
  UNSURE -14: Xaa = Arg,Ser
  UNSURE -22: Xaa = Asp,Gly,Asn,Ser
  UNSURE -21: Xaa = Asp,His
  UNSURE -19: Xaa = Cys,Phe
MESTLGAGIVIAEALQNQLAWLENVWLWXXLXXXIPXILFLFYFPAAYYASRRVGIAVLWISLITEWL

SEQ ID NO: 3163 - protein, 31 aa, Homo Sapiens [sequence omitted]

SEQ ID NO: 3164 - protein, 37 aa, Homo Sapiens [sequence omitted]

SEQ ID NO: 3165 - protein, 21 aa, Homo Sapiens
  kidney
  SIGNAL -19..-1: Von Heijne matrix; score 4.40; seq RGLLLGLAVAAAA/VR
MLRCGGRGLLLGLAVAAAAVR

SEQ ID NO: 3166 - protein, 27 aa, Homo Sapiens [sequence omitted]

SEQ ID NO: 3167 - protein, 22 aa, Homo Sapiens
  kidney
  SIGNAL -14..-1: Von Heijne matrix; score 4.40; seq SLLFIFRSILISC/FS
MSLLFIFRSILISCFSGDFFFF

SEQ ID NO: 3168 - protein, 46 aa, Homo Sapiens [sequence omitted]

SEQ ID NO: 3169 - protein, 108 aa, Homo Sapiens
  kidney
  SIGNAL -29..-1: Von Heijne matrix
  score 4.30
  seq VLLGSTAMATSLT/NV
  UNSURE 61: Xaa = Glu,Gly
MDTSSVGGLELTDQTPVLLGSTAMATSLTNVGNSFSGPANPLVSRSNKFQNSSVEDDDDVVFIEPVQPPPPSVPVVADQRTITFTSSKNXELQGNDSKITPSSKELAS

SEQ ID NO: 3170 - protein, 51 aa, Homo Sapiens
  Kidney
  SIGNAL -31..-1: Von Heijne matrix; score 4.30; seq ILLLTHVPPWILE/NP
MDTGESFSPHTSCRGHWRILLLTHVPPWILENPSCHTRPAVDTGESFSPQR

SEQ ID NO: 3171 - protein, 100 aa, Homo Sapiens
  kidney
  SIGNAL -31..-1: Von Heijne matrix; score 4.30; seq LVLLSVLKEPVSR/SI
MPYLDPYITQPIIQIERKLVLLSVLKEPVSRSIFDYALRSKDITSLFRHLHMRQKKRNGSLPDCPPPEDPAIAQLLKKLLSQGMTEEEEDKLLALKDFMM

SEQ ID NO: 3172 - protein, 44 aa, Homo Sapiens
  kidney
  SIGNAL -29..-1: Von Heijne matrix; score 4.30; seq VLLGSTAMATSLT/NV
MDTSSVGGLELTDQTPVLLGSTAMATSLTNVGNSFSGPANPLVS

SEQ ID NO: 3173 - protein, 50 aa, Homo Sapiens
  kidney
  SIGNAL -28..-1: Von Heijne matrix
  score 4.20
  seq FGLLDFVVQCCDS/LR
  UNSURE -17: Xaa =  * ,Lys,Arg,Trp
  UNSURE 19: Xaa =  * ,Trp
  UNSURE 6: Xaa = Arg,Trp
  UNSURE -16: Xaa = Asp,Asn
  UNSURE 5: Xaa = Lys,Arg
MHVLFNIVTTNXXNHFGLLDFVVQCCDSLRNHXXSFQSSYLRLNHSXHTC

SEQ ID NO: 3174 - protein, 66 aa, Homo Sapiens
  kidney
  SIGNAL -22..-1: Von Heijne matrix
  score 4.20
  seq TAYWLSFMSWAQS/SS
  UNSURE 7: Xaa = Phe,Ile,Leu
MPPQSCCSKTAYWLSFMSWAQSSSFGSRXESTSPCTDHCSGPREEQLCSSRVFHCITHPNGRIHRW

SEQ ID NO: 3175 - protein, 25 aa, Homo Sapiens
  Dystrophic muscle
  SIGNAL -14..-1: Von Heijne matrix; score 4.20; seq SCVFFHFLQGGLG/FG
MSCVFFHFLQGGLGFGSAGRCAGDR

SEQ ID NO: 3176 - protein, 54 aa, Homo Sapiens
  kidney
  SIGNAL -20..-1: Von Heijne matrix; score 4.20; seq LILLPIWINMAQI/QQ
MSISLSSLILLPIWINMAQIQQGGPDEKEKTTALKDLLSRIDLDELMKKDEPPG

SEQ ID NO: 3177 - protein, 52 aa, Homo Sapiens [sequence omitted]

SEQ ID NO: 3178 - protein, 39 aa, Homo Sapiens [sequence omitted]

SEQ ID NO: 3179 - protein, 28 aa, Homo Sapiens
  Muscle
  SIGNAL -24..-1: Von Heijne matrix; score 4.20; seq SLNQILLFLLISC/RT
MRYRLRIQITTSLNQILLFLLISCRTLS

SEQ ID NO: 3180 - protein, 35 aa, Homo Sapiens
  kidney
  SIGNAL -25..-1: Von Heijne matrix
  score 4.20
  seq VLLFFCCSPLYSP/LF
  UNSURE 5: Xaa = His,Gln
MPFFSNQPTQVSVLLFFCCSPLYSPLFLLXLIPHQ

SEQ ID NO: 3181 - protein, 115 aa, Homo Sapiens
  kidney
  SIGNAL -44..-1: Von Heijne matrix; score 4.10; seq IAVGLTCQHVSHA/IS
MRVKDPTKALPEKAKRSKRPTVPHDEDSSDDIAVGLTCQHVSHAISVNHVKRAIAENLWSVCSECLKERRFYDGQLVLTSDIWLCLKCGFQGCGKNSESQHSLKHFKSSRTEPLR

SEQ ID NO: 3182 - protein, 48 aa, Homo Sapiens [sequence omitted]

SEQ ID NO: 3183 - protein, 44 aa, Homo Sapiens
  kidney
  SIGNAL -35..-1: Von Heijne matrix
  score 4.10
  seq VLCCLLIATPTFF/LL
  UNSURE -25: Xaa = Asp,Val
  UNSURE -28: Xaa = Ile,Leu,Pro,Thr
  UNSURE -29: Xaa = Ile,Val
MSLTSRXXIMXTIKIQNISITKVLCCLLIATPTFFLLLPSSIPR

SEQ ID NO: 3184 - protein, 27 aa, Homo Sapiens
  kidney
  SIGNAL -18..-1: Von Heijne matrix
  score 4.10
  seq AGVVSTSVAAAVA/AV
  UNSURE -17: Xaa = Asn,Ser
MXAEAAGVVSTSVAAAVAAVAAPAGAG

SEQ ID NO: 3185 - protein, 32 aa, Homo Sapiens
  Muscle
  SIGNAL -15..-1: Von Heijne matrix; score 4.00; seq IMSSCLALTYTNS/IS
MWIMSSCLALTYTNSISHSLCLERAYSLFKVD

SEQ ID NO: 3186 - protein, 50 aa, Homo Sapiens [sequence omitted]

SEQ ID NO: 3187 - protein, 48 aa, Homo Sapiens
  kidney
  SIGNAL -44..-1: Von Heijne matrix; score 4.00; seq FLLPCVHPFSVIA/VY
MIEPCEKMKHYDMNWFLCMYECFFFHLLETEFLLPCVHPFSVIAVYVF

SEQ ID NO: 3188 - protein, 58 aa, Homo Sapiens
  Muscle
  SIGNAL -55..-1: Von Heijne matrix
  score 4.00
  seq AALCGISLSQXFP/EP
  UNSURE -3: Xaa =  * ,Leu
  UNSURE -46: Xaa = Lys,Arg
MAMWNRPCQXLPQQPLVAEPTAEGEPHLPTGRELTEANRFAYAALCGISLSQXFPEPG

SEQ ID NO: 3189 - protein, 20 aa, Homo Sapiens
  kidney
  SIGNAL -17..-1: Von Heijne matrix; score 4.00; seq CLLVSYAVDSAAG/RF
MEQVCLLVSYAVDSAAGRFG

SEQ ID NO: 3190 - protein, 115 aa, Homo Sapiens
  kidney
  SIGNAL -28..-1: Von Heijne matrix
  score 4.00
  seq ATLRCWASTPVSG/RL
  UNSURE 9: Xaa = Ala,Gly,Pro,Arg
  UNSURE 8: Xaa = Glu,Lys,Met,Val
  UNSURE 10: Xaa = Leu,Arg
  UNSURE 13: Xaa = Met,Arg
MRKISHCLHCWPESGATLRCWASTPVSGRLSSMAVXXXGEXPPQDAFTTQWLVRDLRGKTEKEFKAYVSLFMRHLCEPGADGSETFADGVPREGLSRQQVLTRIGVMSLVKKKGQ

SEQ ID NO: 3191 - protein, 26 aa, Homo Sapiens [sequence omitted]

SEQ ID NO: 3192 - protein, 45 aa, Homo Sapiens
  kidney
  SIGNAL -17..-1: Von Heijne matrix
  score 4.00
  seq VALQCGLTIPALX/LP
  UNSURE -1: Xaa = Cys,Phe,Ser,Tyr
MRCRVALQCGLTIPALXLPQGDEAGDAQDLRGPAQAEYLYIISPS

SEQ ID NO: 3193 - protein, 118 aa, Homo Sapiens
  kidney
  SIGNAL -93..-1: Von Heijne matrix
  score 3.90
  seq LTSAFLWLPRLHI/SV
  UNSURE 13: Xaa = Asp,Glu
  UNSURE 23: Xaa = Pro,Thr
MTVRYGKFLSLLKDGAENDLTWVLKHCERFLKQQQTSIKSSLLCLQGNYAGHDWFVSSLFMIMLGDKEKTFQFLHQFSRLLTSAFLWLPRLHISVRLQSVFKGGFXILRTLYLHSXGR

SEQ ID NO: 3194 - protein, 34 aa, Homo Sapiens
  kidney
  SIGNAL -20..-1: Von Heijne matrix; score 3.90; seq FFWVVLFSAGCKV/IT
MAFDVSCFFWVVLFSAGCKVITSWDQMCIEKEAT

SEQ ID NO: 3195 - protein, 41 aa, Homo Sapiens
  kidney
  SIGNAL -22..-1: Von Heijne matrix; score 3.90; seq HLSSTTSPPWTHA/AI
MLTRLVLSAHLSSTTSPPWTHAAISWELDNVLMPSPRIWPL

SEQ ID NO: 3196 - protein, 51 aa, Homo Sapiens
  kidney
  SIGNAL -40..-1: Von Heijne matrix
  score 3.90
  seq CVNLLLGFEPVIS/RS
  UNSURE 4: Xaa = Arg,Ser
MRYFQGPSPYSEIEIELCDHVYSFQGLCVNLLLGFEPVISRSRXSSLAVES

SEQ ID NO: 3197 - protein, 70 aa, Homo Sapiens
  kidney
  SIGNAL -41..-1: Von Heijne matrix
  score 3.90
  seq LASLECYVPSTNQ/WQ
  UNSURE -34: Xaa =  * ,Cys,Phe,Leu,Trp
  UNSURE -39: Xaa =  * ,Lys,Gln
  UNSURE 5: Xaa =  * ,Phe,His,Ile,Lys,Leu,Met,Asn,Pro,Gln,Ser,Thr,Tyr
  UNSURE -33: Xaa = Ala,Asp,Glu,Gly,His,Ile,Lys,Leu,Met,Asn,Pro,Gln,Arg,Ser,Thr,Val
  UNSURE 6: Xaa = Ala,Pro
  UNSURE -32: Xaa = Leu,Val
  UNSURE -40: Xaa = Lys,Asn
MXXKRTHXXXSVFNGLVYAAGGRNAEGSLASLECYVPSTNQWQPKXXLEVARCCHASAVADGRVLVTGGL

SEQ ID NO: 3198 - protein, 43 aa, Homo Sapiens
  Muscle
  SIGNAL -38..-1: Von Heijne matrix
  score 3.90
  seq LLFFHLLLNDFFT/FY
  UNSURE 3: Xaa = Phe,Ile,Leu,Val
  UNSURE -27: Xaa = Phe,Ile,Val
MFLKVQSQSFYXPYRDCLNFHKSTYLLFFHLLLNDFFTFYXAK

SEQ ID NO: 3199 - protein, 36 aa, Homo Sapiens
  Muscle
  SIGNAL -27..-1: Von Heijne matrix; score 3.90; seq WIILIIYTFQCNS/SL
MQPLKIIFYLSVSIWIILIIYTFQCNSSLSILLLEL

SEQ ID NO: 3200 - protein, 61 aa, Homo Sapiens
  kidney
  SIGNAL -19..-1: Von Heijne matrix
  score 3.90
  seq RVAACTAAAPLQA/HG
  UNSURE 11: Xaa = Arg,Ser
  UNSURE 4,8: Xaa = Asp,Gly
  UNSURE 13: Xaa = Cys,Trp
  UNSURE 20: Xaa = Glu,Gly
  UNSURE 15: Xaa = Gly,Arg
MMRTTARVAACTAAAPLQAHGAXIQQXPDXLXSXRLSRXGLSAGRLHQSETEAELEAPGRA

SEQ ID NO: 3201 - protein, 45 aa, Homo Sapiens
  Kidney
  SIGNAL -34..-1: Von Heijne matrix; score 3.80; seq RWASSCLHPSARS/SN
MEAATTLHPGPRPALPLGARARWASSCLHPSARSSNPAGKSSRTP

SEQ ID NO: 3202 - protein, 35 aa, Homo Sapiens [sequence omitted]

SEQ ID NO: 3203 - protein, 20 aa, Homo Sapiens
  kidney
  SIGNAL -18..-1: Von Heijne matrix
  score 3.80
  seq FXLLFXXFXFFRQ/XG
  UNSURE -7: Xaa =  * ,Tyr
  UNSURE 1: Xaa = Ala,Ser
  UNSURE -16: Xaa = Glu,Gly
  UNSURE -5: Xaa = Leu,Pro
  UNSURE -17: Xaa = Leu,Trp
  UNSURE -12,-8: Xaa = Phe,Leu
MXXFSFXLLFXXFXFFRQXG

SEQ ID NO: 3204 - protein, 31 aa, Homo Sapiens
  kidney
  SIGNAL -23..-1: Von Heijne matrix; score 3.80; seq SVRLLFRFSVIMA/SE
MLLLSEALSESVRLLFRFSVIMASEKQSFQI

SEQ ID NO: 3205 - protein, 27 aa, Homo Sapiens
  kidney
  SIGNAL -17..-1: Von Heijne matrix; score 3.80; seq SLPCTTAFPLLSS/KV
MALISLPCTTAFPLLSSKVSQLLLPLS

SEQ ID NO: 3206 - protein, 57 aa, Homo Sapiens
  Heart
  SIGNAL -37..-1: Von Heijne matrix; score 3.80; seq RVVALPLVRATCT/AV
MSEEEAAQIPRSSVWEQDQQNVVQRVVALPLVRATCTAVCDVYSAAKDRHPLLGSAW

SEQ ID NO: 3207 - protein, 97 aa, Homo Sapiens
  kidney
  SIGNAL -72..-1: Von Heijne matrix; score 3.80; seq LAELTVDPQGALA/IR
MAAAAAAGAASGLPGPVAQGLKEALVDTLTGILSPVQEVRAAAEEQIKVLEVTEEFGVHLAELTVDPQGALAIRQLASVILKQYVETHWCAQSEKFR

SEQ ID NO: 3208 - protein, 130 aa, Homo Sapiens
  kidney
  SIGNAL -117..-1: Von Heijne matrix
  score 3.80
  seq XXXYLNFCPVCYC/FS
  UNSURE -12: Xaa =  * ,Cys,Trp
  UNSURE -55: Xaa =  * ,Glu,Gly,Lys,Arg
  UNSURE -28: Xaa = Ala,Gly
  UNSURE -26: Xaa = Asp,Asn
  UNSURE -11: Xaa = Cys,Phe,Ile,Leu,Pro,Arg,Ser,Thr
  UNSURE -13: Xaa = Phe,Val
MNSGGGFGLGLGFGLTPTSVIQVTNLSSAVTSEQMRTLFSFLGEIEELRLYPPDNAPLAFSSXVCYVKFRDPSSVGVAQHLTNTVFIDRXLXSCSLCRRLVSRFXXXYLNFCPVCYCFSFPRDWQVDSTL

SEQ ID NO: 3209 - protein, 43 aa, Homo Sapiens
  Dystrophic muscle
  SIGNAL -13..-1: Von Heijne matrix; score 3.70; seq MIEMLIFLDCVLS/SK
MIEMLIFLDCVLSSKDTITMFVKFIPIFPFPLQFYLPSFLLLE

SEQ ID NO: 3210 - protein, 81 aa, Homo Sapiens
  kidney
  SIGNAL -79..-1: Von Heijne matrix; score 3.70; seq VIGSLLVLTMLTC/RR
MHPFLAAHGPAFHKGYKHSTINIVDIYPMMCHILGLKPHPNNGTFGHTKCLLVDQWCINLPEAIAIVIGSLLVLTMLTCRR

SEQ ID NO: 3211 - protein, 30 aa, Homo Sapiens [sequence omitted]

SEQ ID NO: 3212 - protein, 85 aa, Homo Sapiens
  kidney
  SIGNAL -31..-1: Von Heijne matrix
  score 3.60
  seq LFIYLVFVECLLC/TR
  UNSURE 9: Xaa =  * ,Gly
  UNSURE 4: Xaa =  * ,Trp
  UNSURE 6: Xaa = Arg,Ser
  UNSURE 5: Xaa = Asp,Glu
MGIDIFYPSHIPDFHPIHLFIYLVFVECLLCTRNXXXLSXFNCDNAQIIFTTGSSSSGGNKPFKSSLCTVHRGQERERIECQGNG

SEQ ID NO: 3213 - protein, 116 aa, Homo Sapiens
  kidney
  SIGNAL -87..-1: Von Heijne matrix
  score 3.60
  seq LILQASLKGELEA/SQ
  UNSURE -37: Xaa = Ser,Thr
MKELNQKLTNKNNKIEDLEQEIKIQKQKQETLQEEITSLQSSVQEYEEKNXKIKQLLVKTKKELADSKQAETDHLILQASLKGELEASQQQVEVYKVRVLLFKIKKMFFHVEVRNG

SEQ ID NO: 3214 - protein, 117 aa, Homo Sapiens
  kidney
  SIGNAL -113..-1: Von Heijne matrix; score 3.60; seq RLLLCILIIVCYI/LF
MGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLLLCILIIVCYILFLM

SEQ ID NO: 3215 - protein, 42 aa, Homo Sapiens [sequence omitted]

SEQ ID NO: 3216 - protein, 36 aa, Homo Sapiens [sequence omitted]

SEQ ID NO: 3217 - protein, 67 aa, Homo Sapiens
  kidney
  SIGNAL -42..-1: Von Heijne matrix
  score 3.50
  seq LLLQGACPCLIFL/RP
  UNSURE 10: Xaa = Glu,Gly
MFLAPSLLITKLLTGSESPDGNPPALGRPLLLQGACPCLIFLRPDENKKEGXEEKKNHKLPLKTSLG

SEQ ID NO: 3218 - protein, 24 aa, Homo Sapiens
  Dystrophic muscle
  SIGNAL -18..-1: Von Heijne matrix; score 3.50; seq SKSCLFYLQKVSG/IP
MDPSASKSCLFYLQKVSGIPGLLT

SEQ ID NO: 3219 - protein, 66 aa, Homo Sapiens [sequence omitted]

SEQ ID NO: 3220 - protein, 42 aa, Homo Sapiens
  kidney
  SIGNAL -22..-1: Von Heijne matrix; score 3.50; seq AQLASPLLPGATP/VA
MKYQMVSGSAQLASPLLPGATPVAGTILKSLLLRTVKMMRVM

SEQ ID NO: 3221 - protein, 38 aa, Homo Sapiens
  kidney
  SIGNAL -35..-1: Von Heijne matrix
  score 3.50
  seq CFWGLMYXWLLLG/SX
  UNSURE 2: Xaa =  * ,Glu,Lys,Gln
  UNSURE -6: Xaa = Ile,Met
MNGTFPGTYVYLVAYGDLRIFGCFWGLMYXWLLLGSXG

SEQ ID NO: 3222 - protein, 97 aa, Homo Sapiens
  Muscle
  SIGNAL -21..-1: Von Heijne matrix
  score 12.70
  seq ILFLLSWSGPLQG/QQ
  UNSURE 64: Xaa =  * ,Ala,Cys,Asp,Glu,Gly,His,Lys,Asn,Pro,Gln,Arg,Ser,Thr,Trp,Tyr
  UNSURE 60: Xaa = Asp,Gly
MGPSTPLLILFLLSWSGPLQGQQHHLVEYMERRLAALEERLAQCQDQSSRHAAELRNFKNKMLPLLEVAEKEREALRTEAXTISXGVDRLEREVDYL

SEQ ID NO: 3223 - protein, 82 aa, Homo Sapiens
  kidney
  SIGNAL -22..-1: Von Heijne matrix; score 10.50; seq LMLLVSSLSPVQG/VL
MKFISTSLLLMLLVSSLSPVQGVLEVYYTSLRCRCVQESSVFIPRRFIDRIQILPRGNGCPRKEIIVWKKNKSIVCVDLKHR

SEQ ID NO: 3224 - protein, 137 aa, Homo Sapiens
  kidney
  SIGNAL -47..-1: Von Heijne matrix
  score 8.00
  seq VLELLAAVCLVRG/GH
  UNSURE 72: Xaa = Ala,Asp
  UNSURE 76: Xaa = Asp,Gly
MNYQYGFNMVMSHPHAVNEIALSLNNKNPRTKALVLELLAAVCLVRGGHEIILSAFDNFKEVCGEKQRFEKLMEHFRNEDNNIDFMVASMQFINIVVHSVEDMNFRVHLQYEFTKLGLXEYLXKLKHTESDKLQVQI

SEQ ID NO: 3225 - protein, 61 aa, Homo Sapiens
  kidney
  SIGNAL -28..-1: Von Heijne matrix; score 7.70; seq LVMCFLSYFGTFA/VE
MAQSIHMYAARVQWGLVMCFLSYFGTFAVEFRHYRYEIVCSEYQENFLSFSESLSEASEYQ

SEQ ID NO: 3226 - protein, 88 aa, Homo Sapiens
  kidney
  SIGNAL -21..-1: Von Heijne matrix
  score 7.10
  seq LHLFHLLIRPXQG/WX
  UNSURE -3: Xaa = Cys,Trp
  UNSURE 3: Xaa = Glu,Gly
  UNSURE 2: Xaa = Glu,Lys
MGSGYSHSLHLFHLLIRPXQGWXXIVPACFWRKKILTPSTGTMELLQVTILFLLPSICSSNSTGVLEAANNSLVVTTTKPSITTPNTW

SEQ ID NO: 3227 - protein, 69 aa, Homo Sapiens
  Muscle
  SIGNAL -16..-1: Von Heijne matrix
  score 6.70
  seq CFSLVLLLTSIWT/TR
  UNSURE 42: Xaa =  * ,Glu,Lys,Gln
  UNSURE 46: Xaa =  * ,Lys
  UNSURE 24: Xaa = Ala,Asp,Glu,Gly,Val
  UNSURE 45: Xaa = His,Leu,Gln
  UNSURE 25: Xaa = Ile,Val
  UNSURE 41: Xaa = any one of the twenty amino acids
MARCFSLVLLLTSIWTTRLLVQGSLRAEELSIQVSCRIMXXTLVSKKANQQLNFTEXXGGXXAAGTKFG

SEQ ID NO: 3228 - protein, 40 aa, Homo Sapiens
  Heart
  SIGNAL -33..-1: Von Heijne matrix; score 6.70; seq MTCLSVLFGYATS/HP
MAMRYNRLTVLAGAMLALGLMTCLSVLFGYATSHPQGLYI

SEQ ID NO: 3229 - protein, 53 aa, Homo Sapiens
  kidney
  SIGNAL -26..-1: Von Heijne matrix; score 6.30; seq RQLLLPLPPFSFP/AP
MPQQPVEQGSPLLRQLLLPLPPFSFPAPSPCPSWPVALGSHGVAYWGSCSLGH

SEQ ID NO: 3230 - protein, 90 aa, Homo Sapiens
  kidney
  SIGNAL -80..-1: Von Heijne matrix
  score 6.20
  seq RASLLPMLLGSWA/FL
  UNSURE -34: Xaa = Ile,Met
MPSRSPFTWSHLCWRAGRCPRWRACLSSSSVRMCSPAAPSRFGALGXSARRWPRRDADTWCAPQGVMRASLLPMLLGSWAFLPPSCSPRA

SEQ ID NO: 3231 - protein, 95 aa, Homo Sapiens
  Muscle
  SIGNAL -40..-1: Von Heijne matrix
  score 6.00
  seq LTYGIILTHGASG/DM
  UNSURE 50: Xaa = Glu,Lys
MSHTEVKLKIPFGNKLLDAVCLVPNKSLTYGIILTHGASGDMNLPHLMSLASHLASHGFFCLRFTCKGLNIVHRIKAYKSVLNYLKTSGXYKLAG

SEQ ID NO: 3232 - protein, 76 aa, Homo Sapiens
  kidney
  SIGNAL -40..-1: Von Heijne matrix
  score 6.00
  seq LCXEFXSVASCDA/AV
  UNSURE -8: Xaa = Ala,Thr
  UNSURE 9: Xaa = Asp,Glu
  UNSURE 36: Xaa = Gly,Arg,Trp
  UNSURE -11: Xaa = Leu,Val
MELGSCLEGGREAAEEEGEPEVKKRRLLCXEFXSVASCDAAVAQCFLAXNDWEMERALNSYFEPPVEESALERRPX

SEQ ID NO: 3233 - protein, 57 aa, Homo Sapiens
  kidney
  SIGNAL -36..-1: Von Heijne matrix; score 5.80; seq AFVSGLLIGQCSS/QK
MGRTYIVEETVGQYLSNINLQGKAFVSGLLIGQCSSQKDYVILATRTPPKEEQSENL

SEQ ID NO: 3234 - protein, 122 aa, Homo Sapiens
  kidney
  SIGNAL -21..-1: Von Heijne matrix; score 5.60; seq CLSCLLIPLALWS/II
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCR

SEQ ID NO: 3235 - protein, 150 aa, Homo Sapiens
  kidney
  SIGNAL -21..-1: Von Heijne matrix
  score 5.60
  seq CLSCLLIPLALWS/II
  UNSURE 114: Xaa = Ala,Thr
MGSRKCGGCLSCLLIPLALWSIIVNILLYFPNGQTSYASSNKLTNYVWYFEGICFSGIMMLIVTTVLLVLENNNNYKCCQSENCSKKYVTLLSIIFSSLGIAFSGYCLVISALGLVQGPYCRTLDGWEYAFEGTXGRFLTDSSIWIQCLE

SEQ ID NO: 3236 - protein, 36 aa, Homo Sapiens
  kidney
  SIGNAL -21..-1: Von Heijne matrix; score 5.50; seq SFLPSALVIWTSA/AF
MWWFQQGLSFLPSALVIWTSAAFIFSYITAVTLHHI

SEQ ID NO: 3237 - protein, 59 aa, Homo Sapiens [sequence omitted]

SEQ ID NO: 3238 - protein, 37 aa, Homo Sapiens
  kidney
  SIGNAL -29..-1: Von Heijne matrix; score 13.40; seq SLLLVQLLTPCSA/QF
MKMASSLAFLLLNFHVSLLLVQLLTPCSAQFSVLGPL

SEQ ID NO: 3239 - protein, 47 aa, Homo Sapiens
  kidney
  SIGNAL -42..-1: Von Heijne matrix; score 5.20; seq LLFDLVCHEFCQS/DD
MHILQLLTTVDDGIQAIVHCPDTGKDIWNLLFDLVCHEFCQSDDPAR

SEQ ID NO: 3240 - protein, 102 aa, Homo Sapiens
  kidney
  SIGNAL -43..-1: Von Heijne matrix
  score 5.20
  seq PMQLLQVLSDVLA/EI
  UNSURE -17: Xaa = Asp,Val
MSDQIKFIMDSLNKEPFRKNYNLITFXSLEPMQLLQVLSDVLAEIDPKQLVDIREEMPEQTAKRMLSLLGILKYKPSGNATDMSTFRQGLVIGSKPVIYPVL

SEQ ID NO: 3241 - protein, 93 aa, Homo Sapiens
  kidney
  SIGNAL -79..-1: Von Heijne matrix
  score 4.60
  seq IIHAXGLVRECLA/XT
  UNSURE 1: Xaa = Asp,Glu
  UNSURE -73: Xaa = Asp,Tyr
  UNSURE -37: Xaa = Glu,Gly
  UNSURE -50: Xaa = Met,Val
  UNSURE -9: Xaa = Pro,Arg,Thr
MATSSQXRQLLSDYGPPSLGYTQGTGNSQXPQSKYAELLAIIXELGKEIRPMYAGSKSAMERLKRGIIHAXGLVRECLAXTERMPDPSCLVGF

SEQ ID NO: 3242 - protein, 59 aa, Homo Sapiens
  kidney
  SIGNAL -15..-1: Von Heijne matrix; score 4.50; seq LLGAAAVAALGRG/RA
MRLLGAAAVAALGRGRAPASLGWQRKQVNWKACRWSSSGVIPNEKIRNIGISAHIDSGK

SEQ ID NO: 3243 - protein, 51 aa, Homo Sapiens
  kidney
  SIGNAL -16..-1: Von Heijne matrix; score 4.50; seq RLLLRRFLASVIS/RK
MAQRLLLRRFLASVISRKPSQGQWPPLTSRALQTPQCSPGGLTVTPNPAPG

SEQ ID NO: 3244 - protein, 32 aa, Homo Sapiens
  kidney
  SIGNAL -16..-1: Von Heijne matrix; score 4.40; seq LNSLSALAELAVG/SR
MFRLNSLSALAELAVGSRWYHGGSQPIQIRLA

SEQ ID NO: 3245 - protein, 90 aa, Homo Sapiens
  Muscle
  SIGNAL -61..-1: Von Heijne matrix; score 3.90; seq YTAVSVLAGPRWA/DP
MSGSNGSKENSHNKARTSPYPGSKVERSQVPNEKVGWLVEWQDYKPVEYTAVSVLAGPRWADPQISESNFSPKFNEKDGHVERKSKNGLY

SEQ ID NO: 3246 - protein, 21 aa, Homo Sapiens
  Dystrophic muscle
  SIGNAL -16..-1: Von Heijne matrix
  score 3.50
  seq TLMFSLTAQWXTS/RS
  UNSURE -3: Xaa = Phe,Ile
MRTTLMFSLTAQWXTSRSSFQ

SEQ ID NO: 3247 - protein, 104 aa, Homo Sapiens
  kidney
  SIGNAL -25..-1: Von Heijne matrix; score 14.10; seq LTLLLLLTLLAFA/GY
MSDLLLLGLIGGLTLLLLLTLLAFAGYSGLLAGVEVSAGSPPIRNVTVAYKFHMGLYGETGRLFTESCSISPKLRSIAVYYDNPHMVPPDKCRCAVGSILSEGE

SEQ ID NO: 3248 - protein, 78 aa, Homo Sapiens
  Dystrophic muscle
  SIGNAL -32..-1: Von Heijne matrix
  score 11.40
  seq LWSLALWLPLALS/VS
  UNSURE -18: Xaa = Gln,Arg
MEGTEMGARPGGHPXKWSFLWSLALWLPLALSVSLFLGLSLSPPQPGLSLWCTLSYCCEQWKFKGTPSPALLNLGTRG

SEQ ID NO: 3249 - protein, 86 aa, Homo Sapiens
  kidney
  SIGNAL -55..-1: Von Heijne matrix
  score 11.20
  seq LLFALGSLGLIFA/LI
  UNSURE -48: Xaa =  * ,Ser,Tyr
  UNSURE 22: Xaa = Ala,Glu
  UNSURE -54: Xaa = Ala,Pro,Thr
  UNSURE 5: Xaa = Arg,Ser
  UNSURE -20: Xaa = His,Pro
MXFLRKVXSILSLQVLLTTVTSTVFLYFESVRTFVXESPALILLFALGSLGLIFALILNXHKYPLNLYLLFGFTLLXALTVAVVVT

SEQ ID NO: 3250 - protein, 45 aa, Homo Sapiens
  Muscle
  SIGNAL -38..-1: Von Heijne matrix; score 10.80; seq MLLLLLLLGSGQG/PQ
MAATLGPLGSWQQWRRCLSARDGSRMLLLLLLLGSGQGPQQVGAG

SEQ ID NO: 3251 - protein, 53 aa, Homo Sapiens
  kidney
  SIGNAL -41..-1: Von Heijne matrix
  score 9.90
  seq ILPFLLFPFPVNA/RS
  UNSURE 4: Xaa = Leu,Ser
MSSWMYLGYPIVTSNTTCLKLISSSFPQILPFLLFPFPVNARSHXVAQTKSPR

SEQ ID NO: 3252 - protein, 38 aa, Homo Sapiens [sequence omitted]

SEQ ID NO: 3253 - protein, 110 aa, Homo Sapiens
  kidney
  SIGNAL -93..-1: Von Heijne matrix
  score 9.60
  seq LSLSLGASAPVQC/QQ
  UNSURE 9: Xaa =  * ,Ala,Cys,Asp,Glu,Phe,Gly,Leu,Ser,Val,Trp,Tyr
  UNSURE -75: Xaa =  * ,Lys,Arg,Trp
  UNSURE -69: Xaa = Ala,Cys,Gly,Ser
  UNSURE -68: Xaa = Ala,Gly
  UNSURE -74: Xaa = Ala,Pro
  UNSURE -77: Xaa = His,Asn
  UNSURE -76: Xaa = Leu,Val
MRHGFIQQQFSLTAFSXXXXIFTLXXLSQLLSSAAPKHTAAPTALPCLQGQQLNSLSLGTSELSCVLASSCLSTKTDPSGLSLSLGASAPVQCQQDNYTFCXQYWLRARH

SEQ ID NO: 3254 - protein, 77 aa, Homo Sapiens
  kidney
  SIGNAL -41..-1: Von Heijne matrix
  score 9.50
  seq LIIFLSFLPFINS/SF
  UNSURE 26: Xaa = Glu,Gly
  UNSURE 27: Xaa = Ser,Thr
MFQNIQKCLNVPFVRGYHVFYINLNAVILIIFLSFLPFINSSFVYKTNPLYDAISNYVFSFRYPNLXXFALDVRLVF

SEQ ID NO: 3255 - protein, 27 aa, Homo Sapiens
  kidney
  SIGNAL -20..-1: Von Heijne matrix; score 9.20; seq FPVLALFLSGSLA/LF
MSLSQRGFPVLALFLSGSLALFHHTSG

SEQ ID NO: 3256 - protein, 70 aa, Homo Sapiens
  kidney
  SIGNAL -29..-1: Von Heijne matrix
  score 8.90
  seq ALLIVCDVPSASA/QR
  UNSURE 38: Xaa = Ala,Asp,Glu
MAARWRFWCVSVTMVVALLIVCDVPSASAQRKKEMVLSEKVSQLMEWTNKRPVIRMNGDKFRRLVKXPPR

SEQ ID NO: 3257 - protein, 46 aa, Homo Sapiens
  kidney
  SIGNAL -32..-1: Von Heijne matrix
  score 8.80
  seq VPMLLLIVGGSFG/LR
  UNSURE 6: Xaa = Leu,Pro,Gln,Arg
MFAPAVMRAFRKNKTLGYGVPMLLLIVGGSFGLREFSXIRYDAVKG

SEQ ID NO: 3258 - protein, 103 aa, Homo Sapiens
  Kidney
  SIGNAL -37..-1: Von Heijne matrix
  score 8.50
  seq LLVLLLYAPVGFC/LL
  UNSURE 5: Xaa = Gly,Arg
MELPSGPGPERLFDSHRLPGDCFLLLVLLLYAPVGFCLLVLXLFLGIHVFLVSCALPDSVLRRFVVRTMCAVLGLVARQEDSGLRDHSVRVLISNHVTPFDHQ

SEQ ID NO: 3259 - protein, 92 aa, Homo Sapiens
  kidney
  SIGNAL -90..-1: Von Heijne matrix
  score 8.40
  seq SLVLLTVTPSXRQ/QE
  UNSURE -37: Xaa =  * ,Glu,Lys,Gln
  UNSURE -31: Xaa = Asp,Glu,Gly,His,Leu,Gln,Arg,Val
  UNSURE -82: Xaa = Glu,Lys
  UNSURE -30: Xaa = Leu,Met,Val
  UNSURE -79: Xaa = Phe,Val
  UNSURE -3: Xaa = Ser,Thr
MAQSQGWVXRYXKAFCKGFFVAVPVAVTFLDRVACVARVEGASMQPSLNPGGSXSSDVVXXNHWKVRNFEVHRGDIVSLVLLTVTPSXRQQE

SEQ ID NO: 3260 - protein, 85 aa, Homo Sapiens
  kidney
  SIGNAL -23..-1: Von Heijne matrix
  score 8.10
  seq WLLVLSFVFGCNV/LR
  UNSURE 7: Xaa = Ala,Gly,Val
  UNSURE 53: Xaa = Asp,Glu
  UNSURE 22: Xaa = Glu,Gln
  UNSURE 12: Xaa = His,Gln
  UNSURE 5: Xaa = Leu,Arg
  UNSURE 9,11: Xaa = Leu,Val
  UNSURE 8: Xaa = Phe,Leu
MSSAAADHWAWLLVLSFVFGCNVLRILXPXXXIXXVQGAAEGRGXESQMRAEIQDMKQELSTVNMMDEFARYARLXRKINKMTDK

SEQ ID NO: 3261 - protein, 34 aa, Homo Sapiens
  kidney
  SIGNAL -20..-1: Von Heijne matrix; score 8.00; seq HVFFLLLLAHIIA/LE
MNLFKTNHVFFLLLLAHIIALESIAWFTVFYFGN

SEQ ID NO: 3262 - protein, 43 aa, Homo Sapiens
  Dystrophic muscle
  SIGNAL -24..-1: Von Heijne matrix; score 7.90; seq LLLPRVLLTMASG/SP
MPALLPVASRLLLLPRVLLTMASGSPPTQPSPASDSGSGYVPG

SEQ ID NO: 3263 - protein, 96 aa, Homo Sapiens
  kidney
  SIGNAL -66..-1: Von Heijne matrix; score 7.90; seq LLLPRVLLTMASG/SP
MIGSGLAGSGGAGGPSSTVTWCALFSNHVAATQASLLLSFVWMPALLPVASRLLLLPRVLLTMASGSPPTQPSPASDSGSGYVPGSVSAAFVTCPR

SEQ ID NO: 3264 - protein, 104 aa, Homo Sapiens
  kidney
  SIGNAL -24..-1: Von Heijne matrix
  score 7.90
  seq LLLPRVLLTMASG/SP
  UNSURE 65: Xaa = Lys,Met,Thr
MPALLPVASRLLLLPRVLLTMASGSPPTQPSPASDSGSGYVPGSVSAAFVTCPNEKVAKEIARAVVEKRLAACVNLIPQITSIYEWKGXIEEDSEVLMMIKTQA

SEQ ID NO: 3265 - protein, 121 aa, Homo Sapiens
  kidney
  SIGNAL -92..-1: Von Heijne matrix; score 7.60; seq FLLLTVALLASYS/VH
MEASWGSFNAERGWYVSVQQPEEAEAEELSPLLSNELHRQRSPGVSFGLSVFNLMNAIMGSGILGLAYVMANTGVFGFSFLLLTVALLASYSVHLLLSMCIQTAVTSYEDLGLFAFGLPGL

SEQ ID NO: 3266 - protein, 19 aa, Homo Sapiens
  Heart
  SIGNAL -17..-1: Von Heijne matrix; score 7.60; seq FFLLLRFFLRIDG/VP
MPSSFFLLLRFFLRIDGVP

SEQ ID NO: 3267 - protein, 46 aa, Homo Sapiens
  Dystrophic muscle
  SIGNAL -19..-1: Von Heijne matrix; score 7.60; seq FIVGIYFLSSCRA/EE
MKRTHLFIVGIYFLSSCRAEEGLNFPTYDGKDRVVSLSEKNFKQVL

SEQ ID NO: 3268 - protein, 61 aa, Homo Sapiens
  Muscle
  SIGNAL -23..-1: Von Heijne matrix
  score 7.40
  seq VLLLAALPPVLLP/GA
  UNSURE 32: Xaa = Glu,Lys
MGDKIWLPFPVLLLAALPPVLLPGAAGFTPSLDSDFTFTLPAGQKECFYQPMPLXASLEIE

SEQ ID NO: 3269 - protein, 57 aa, Homo Sapiens
  kidney
  SIGNAL -37..-1: Von Heijne matrix
  score 7.30
  seq LLSACLVTLWGLG/EP
  UNSURE 13: Xaa = His,Gln
MPHSSLHPSIPCPRGHGAQKAALVLLSACLVTLWGLGEPPEHTLRYLVLXLASLQLG

SEQ ID NO: 3270 - protein, 54 aa, Homo Sapiens
  Dystrophic muscle
  SIGNAL -29..-1: Von Heijne matrix; score 7.30; seq HLLLLLLPAPTLK/GL
MGAWGRGWPWEERQGHHLLLLLLPAPTLKGLGAAQLPLCPSGGLSPLLTLLQSG

SEQ ID NO: 3271 - protein, 124 aa, Homo Sapiens
  kidney
  SIGNAL -75..-1: Von Heijne matrix; score 7.20; seq LLFIIGLIGCCAT/IR
MGQCGITSSKTVLVFLNLIFWGAAGILCYVGAYVFITYDDYDHFFEDVYTLIPAVVIIAVRALLFIIGLIGCCATIRESRCGLATFVIILLLVFVTEVVVVVLGYVYRAKVENEVDRSIQKVYK

SEQ ID NO: 3272 - protein, 115 aa, Homo Sapiens
  kidney
  SIGNAL -65..-1: Von Heijne matrix
  score 7.00
  seq IGHFLCLVILVYC/AE
  UNSURE -63: Xaa = Ala,Ser
  UNSURE 17: Xaa = Lys,Gln
MPXAFSVSSFPVSIPAVLTQTDWTEPWLMGLATFHALCVLLTCLSSRSYRLQIGHFLCLVILVYCAEYINEAAAMNWRLFSXYQYFDSRGMFISIVFSAPLLVNAMIIVVMWVWK

SEQ ID NO: 3273 - protein, 26 aa, Homo Sapiens
  kidney
  SIGNAL -14..-1: Von Heijne matrix; score 6.70; seq LLLSLFFPLRISL/SP
MLLLSLFFPLRISLSPSNHLWSASSG

SEQ ID NO: 3274 - protein, 80 aa, Homo Sapiens
  kidney
  SIGNAL -23..-1: Von Heijne matrix
  score 6.60
  seq LILVLQLLLRIRR/NR
  UNSURE 7: Xaa = Ala,Pro
METGERARLILILVLQLLLRIRRNRQQRCXASSATAPSSHGCDLRGGKLNFKTTPMDADSDVALDILITNVVCVFRTRCR

SEQ ID NO: 3275 - protein, 66 aa, Homo Sapiens
  kidney
  SIGNAL -41..-1: Von Heijne matrix
  score 6.40
  seq ILGCSSVCQLCTG/RQ
  UNSURE -37: Xaa =  * ,Gln
  UNSURE -21: Xaa = Leu,Arg
  UNSURE -38: Xaa = Phe,Leu
MCGXXFSLPCLRLFLVVTCYXLLLLHKEILGCSSVCQLCTGRQINCRNLGLSSILRIFLKVQFFCI

SEQ ID NO: 3276 - protein, 119 aa, Homo Sapiens
  kidney
  SIGNAL -73..-1: Von Heijne matrix
  score 6.40
  seq ACCFLSAFSPTLT/KS
  UNSURE -29: Xaa =  * ,Glu,Gly
  UNSURE -32: Xaa = Gly,Val
  UNSURE -30: Xaa = Lys,Pro,Gln,Thr
MNPVTESPSCLFSPPSESALASQLALSASCDQRAPFSLAGVXSXXPRLASRQVAPPFGSRACCFLSAFSPTLTKSAAATSTAHTFLANQLSCLFTKCLHNNYSSSLRLTKKQEKSTTPQ

SEQ ID NO: 3277 - protein, 30 aa, Homo Sapiens
  Dystrophic muscle
  SIGNAL -21..-1: Von Heijne matrix; score 6.30; seq LGLSVLLTAATVA/GV
MSRSSKVVLGLSVLLTAATVAGVHVKQQWD

SEQ ID NO: 3278 - protein, 58 aa, Homo Sapiens
  Muscle
  SIGNAL -26..-1: Von Heijne matrix; score 6.30; seq GVGLVTLLGLAVG/SY
MGIQTSPVLLASLGVGLVTLLGLAVGSYLVRRSRRPQVTLLDPSEKYLLRLLDKTTPG

SEQ ID NO: 3279 - protein, 58 aa, Homo Sapiens
  Muscle
  SIGNAL -51..-1: Von Heijne matrix
  score 6.20
  seq VLLLSSAXLVXXS/SP
  UNSURE -3: Xaa = Ala,Asp,Gly,His,Asn,Pro,Arg,Ser,Thr
  UNSURE -31: Xaa = Ala,Pro
  UNSURE -2: Xaa = Asp,His,Asn,Tyr
  UNSURE -43: Xaa = Cys,Phe,Gly,Leu,Val,Trp
  UNSURE -6: Xaa = His,Leu,Pro,Gln,Arg
MYPSYLLIXPPIPSQFLKQCXPPTLSDPFLPLALRSLDVLLLSSAXLVXXSSPLEFIR

SEQ ID NO: 3280 - protein, 58 aa, Homo Sapiens
  kidney
  SIGNAL -33..-1: Von Heijne matrix
  score 6.20
  seq ILLLXTFQTWCLR/IS
  UNSURE -9: Xaa =  * ,Leu,Gln
  UNSURE -19: Xaa = Ala,Thr
  UNSURE -27: Xaa = Asp,Glu
  UNSURE 12: Xaa = Asp,Gly
  UNSURE 10: Xaa = Ile,Lys
  UNSURE 17: Xaa = Pro,Arg,Thr
MEQKHRXELEQLKLXTKENKILLLXTFQTWCLRISHLGYQKHXRXGCLDXRSSLCCPW

SEQ ID NO: 3281 - protein, 115 aa, Homo Sapiens
  kidney
  SIGNAL -23..-1: Von Heijne matrix
  score 5.90
  seq TLKFLTLLQKSNA/KR
  UNSURE 3: Xaa = Ala,Pro
MMTAPVLAAQTLKFLTLLQKSNAKRXNLDRLHDELWYNDPGQMNDGPLCKCSAKARRTGIRHSIYPGEEAIKPCRPMTNNAGRLFHYRITVSPPTNFLTDRPTVIEYDDHEYIFE

SEQ ID NO: 3282 - protein, 102 aa, Homo Sapiens
  kidney
  SIGNAL -27..-1: Von Heijne matrix
  score 5.90
  seq ALALAXAPDLAQA/PL
  UNSURE -8: Xaa = Ile,Leu
  UNSURE 66: Xaa = Ile,Met
  UNSURE 67: Xaa = Phe,Ile,Leu,Val
MDSAACAAAATPVPALALAXAPDLAQAPLALPGLLSPSCLLSSGQEVNGSERGTCLWRPWLSSTNDSPRQMRKLVDLAAGGATAAEVTKAESXXHHPVRLFW

SEQ ID NO: 3283 - protein, 114 aa, Homo Sapiens
  kidney
  SIGNAL -24..-1: Von Heijne matrix
  score 5.70
  seq ILGLLGLLGTLVA/ML
  UNSURE 33: Xaa = His,Tyr
MASLGLQLVGYILGLLGLLGTLVAMLLPSWKTSSYVGASIVTAVGFSKGLWMECATXSTGITQCDIYSTLLGLPADIQAAQAMMVTSSAISSLACIISVVGMRCTVFCQESRAR

SEQ ID NO: 3284 - protein, 55 aa, Homo Sapiens
  kidney
  SIGNAL -24..-1: Von Heijne matrix; score 5.70; seq ILGLLGLLGTLVA/ML
MASLGLQLVGYILGLLGLLGTLVAMLLPSWKTSSYVGASIVTAVGFSKGLWMECA

SEQ ID NO: 3285 - protein, 42 aa, Homo Sapiens
  kidney
  SIGNAL -18..-1: Von Heijne matrix; score 5.60; seq LLCECLLLVAGYA/HD
MLCSLLLCECLLLVAGYAHDDDWIDPTDMLNYDAASGTMRKS

SEQ ID NO: 3286 - protein, 25 aa, Homo Sapiens
  kidney
  SIGNAL -22..-1: Von Heijne matrix; score 5.50; seq LWYVCPCPSGAWM/VP
MASRLCGGALWYVCPCPSGAWMVPG

SEQ ID NO: 3287 - protein, 63 aa, Homo Sapiens
  Muscle
  SIGNAL -28..-1: Von Heijne matrix
  score 5.50
  seq LGYLVLSEGAVLA/SS
  UNSURE 12: Xaa = Ala,Ser,Thr
MTSALTQGLERIPDQLGYLVLSEGAVLASSGDLENDEQAXSAISELVSTACGFRLHRGMNVPR

SEQ ID NO: 3288 - protein, 77 aa, Homo Sapiens
  kidney
  SIGNAL -42..-1: Von Heijne matrix
  score 5.40
  seq ITGVILLAVGIWG/KV
  UNSURE 9: Xaa = Ala,Ser
  UNSURE -19: Xaa = Asp,Tyr
  UNSURE -15: Xaa = Cys,Phe
  UNSURE 21: Xaa = Gly,Val
  UNSURE 29: Xaa = Ile,Met
  UNSURE -17: Xaa = Phe,Ile,Leu,Met,Val
MASPSRRLQTKPVITCFKSVLLIXTXIXWITGVILLAVGIWGKVSLENYFXLLNEKATNVPFXLIATGTVXILLGYR

SEQ ID NO: 3289 - protein, 61 aa, Homo Sapiens
  kidney
  SIGNAL -20..-1: Von Heijne matrix
  score 5.30
  seq VLLGSGLTILSQP/LM
  UNSURE 29: Xaa =  * ,Cys,Trp
  UNSURE 30: Xaa =  * ,Gln
  UNSURE 33: Xaa = Cys,Gly,Arg,Ser
MADAASQVLLGSGLTILSQPLMYVKVLIQVGYEPLPPTIGRNIFGRQVXXLPXLFSYAQHG

SEQ ID NO: 3290 - protein, 31 aa, Homo Sapiens
  Kidney
  SIGNAL -20..-1: Von Heijne matrix; score 5.30; seq ALIFGGFISLIGA/AF
MSRNLRTALIFGGFISLIGAAFYPIYFRPHG

SEQ ID NO: 3291 - protein, 23 aa, Homo Sapiens [sequence omitted]

SEQ ID NO: 3292 - protein, 35 aa, Homo Sapiens
  kidney
  SIGNAL -14..-1: Von Heijne matrix; score 5.00; seq SLVAVFLSCGLIS/KN
MSLVAVFLSCGLISKNHMLLNLPGILIPHNANHLL

SEQ ID NO: 3293 - protein, 42 aa, Homo Sapiens
  Kidney
  SIGNAL -24..-1: Von Heijne matrix; score 5.00; seq GALAVGAVPVVLS/AM
MMKRAAAAAVGGALAVGAVPVVLSAMGFTGAGIAASSIAAHG

SEQ ID NO: 3294 - protein, 137 aa, Homo Sapiens
  kidney
  SIGNAL -81..-1: Von Heijne matrix; score 4.90; seq LISFSWFANYIRA/GT
MAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFTVFAIVFIITRLVILPFWILHC

SEQ ID NO: 3295 - protein, 78 aa, Homo Sapiens
  kidney
  SIGNAL -16..-1: Von Heijne matrix; score 4.80; seq SLFIYIFLTCSNT/SP
MIISLFIYIFLTCSNTSPSYQGTQLGLGLPSAQWWPLTGRRMQCCRLFCFLLQNCLFPFPLHLIQHDPCELVLTISGT

SEQ ID NO: 3296 - protein, 86 aa, Homo Sapiens
  kidney
  SIGNAL -32..-1: Von Heijne matrix; score 4.70; seq LQMLLGFVGRSKS/GL
MAAELVEAKNMVMSFRVSDLQMLLGFVGRSKSGLKHELVTRALQLVQFDCSPELFKKIKELYETRYAKKNSEPAPQPHRPLDPLTG

SEQ ID NO: 3297 - protein, 67 aa, Homo Sapiens
  kidney
  SIGNAL -60..-1: Von Heijne matrix
  score 4.70
  seq VHALCPLSPLVTT/GC
  UNSURE -54: Xaa = Ala,Asp
  UNSURE -32: Xaa = Ala,Thr
  UNSURE -44: Xaa = Asp,Glu
  UNSURE -42: Xaa = Cys,Phe,Tyr
  UNSURE -37: Xaa = His,Pro,Arg
  UNSURE -48: Xaa = Lys,Thr
  UNSURE -49: Xaa = Pro,Arg
MTGLSMXGGGSXXGDVXPXYYGKXGPLRXLPEPSGPLPPSSGLSQPQVHALCPLSPLVTTGCCGQAA

SEQ ID NO: 3298 - protein, 33 aa, Homo Sapiens
  kidney
  SIGNAL -31..-1: Von Heijne matrix
  score 4.60
  seq GLLGXGLXXXSLT/AG
  UNSURE -5: Xaa =  * ,Glu,Gly,Trp
  UNSURE -9: Xaa = Ala,Ser
  UNSURE -21: Xaa = Asn,Thr
  UNSURE -6: Xaa = Phe,Leu
  UNSURE -4: Xaa = Phe,Ser
MQMYSRQLASXEWLTIQGGLLGXGLXXXSLTAG

SEQ ID NO: 3299 - protein, 122 aa, Homo Sapiens
  kidney
  SIGNAL -54..-1: Von Heijne matrix
  score 4.30
  seq LIVWLLVKSFSES/GI
  UNSURE 51: Xaa = Glu,Gly,Gln,Arg
  UNSURE 50: Xaa = His,Leu,Arg
  UNSURE 64: Xaa = Ile,Met
MASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIXXMKHAQETTSLLWXLISH

SEQ ID NO: 3300 - protein, 42 aa, Homo Sapiens
  Heart
  SIGNAL -20..-1: Von Heijne matrix; score 4.30; seq LLDSSLMASGTAS/RS
MDKDSQGLLDSSLMASGTASRSEDEESLAGQKRASSQALGTG

SEQ ID NO: 3301 - protein, 83 aa, Homo Sapiens
  kidney
  SIGNAL -36..-1: Von Heijne matrix
  score 4.20
  seq CLAVSWEAAGCHG/AG
  UNSURE -26: Xaa = Asn,Thr
  UNSURE -24: Xaa = Leu,Arg
  UNSURE -25: Xaa = Met,Arg
MGLLTFGYIEXXXKTEHNPDHHSCLAVSWEAAGCHGAGTQQSPLGVAGPWRPRPPCVGSLLAARSLHKQVILFGLLGFAYDHW

SEQ ID NO: 3302 - protein, 65 aa, Homo Sapiens
  Dystrophic muscle
  SIGNAL -16..-1: Von Heijne matrix
  score 4.10
  seq YAAVAGVLAGVES/RQ
  UNSURE 19: Xaa = Ala,Thr
  UNSURE 36: Xaa = Cys,Tyr
  UNSURE 27: Xaa = Lys,Asn
MGLYAAVAGVLAGVESRQGSNQGAGVLQQLPEREXAVRAGVRXAALLRRAGXRDLQRRPPQCEEA

SEQ ID NO: 3303 - protein, 94 aa, Homo Sapiens
  Heart
  SIGNAL -62..-1: Von Heijne matrix; score 4.10; seq LDAVIASAGLLRA/EK
MGLYAAAAGVLAGVESRQGSIKGLVYSSNFQNVKQLYALVCETQRYSAVLDAVIASAGLLRAEKKLRPHLAKVLVYELLLGKGFRGGGGRWKAR

SEQ ID NO: 3304 - protein, 151 aa, Homo Sapiens
  kidney
  SIGNAL -64..-1: Von Heijne matrix; score 4.10; seq WLLRLAYLADIFT/KL
MGAQHTALLLNTEVRWLSRGKVLVRLFELRRELLVFMDSAFRLSDCLTNSSWLLRLAYLADIFTKLNEVNLSMQGKNVTVFTVFDKMSSLLRKLEFWASSVEEENFDCFPTLSDFLTEINSTVDKDICSAIVQHLRGLRATLLKYFPVTND

SEQ ID NO: 3305 - protein, 44 aa, Homo Sapiens
  Heart
  SIGNAL -25..-1: Von Heijne matrix; score 4.00; seq LVVMVPLVGLIHL/GW
MSLRNLWRDYKVLVVMVPLVGLIHLGWYRIKSSPVFQIPKNDNM

SEQ ID NO: 3306 - protein, 105 aa, Homo Sapiens
  Heart
  SIGNAL -51..-1: Von Heijne matrix; score 3.90; seq GKLLQLVLGCAIS/CE
MVLRSLVEYSQDVLAHPVSEEHLPDVSLIGEFSDPAELGKLLQLVLGCAISCEKKQDHIQRIMTLEESVQHVVMEAIQELMTKDTPDSLSPETYGNFDSQSRSTG

SEQ ID NO: 3307 - protein, 16 aa, Homo Sapiens
  kidney
  SIGNAL -13..-1: Von Heijne matrix; score 3.90; seq MIHGFCLAPTTSA/KN
MIHGFCLAPTTSAKNA

SEQ ID NO: 3308 - protein, 26 aa, Homo Sapiens
  kidney
  SIGNAL -17..-1: Von Heijne matrix
  score 3.70
  seq RTWCLACVEASPG/QP
  UNSURE -16: Xaa = Leu,Pro
MXCPRTWCLACVEASPGQPFLPPRPG

SEQ ID NO: 3309 - protein, 67 aa, Homo Sapiens
  Dystrophic muscle
  SIGNAL -21..-1: Von Heijne matrix
  score 3.70
  seq ETCALASHSGSSG/SK
  UNSURE 41: Xaa = Ile,Leu
MADVEDGEETCALASHSGSSGSKSGGDKMFSLKKWNAVAMWSWDVECDTCAICRVQVMDACXRCQAG

SEQ ID NO: 3310 - protein, 28 aa, Homo Sapiens
  kidney
  SIGNAL -26..-1: Von Heijne matrix
  score 3.70
  seq IIMFLLIIVCGSP/RP
  UNSURE -14: Xaa =  * ,Glu
  UNSURE -15: Xaa =  * ,Tyr
MFKVAAPPMLIXXIIMFLLIIVCGSPRP

SEQ ID NO: 3311 - protein, 51 aa, Homo Sapiens
  Muscle
  SIGNAL -21..-1: Von Heijne matrix
  score 3.60
  seq FXMCLWSLRNLFS/RC
  UNSURE -12: Xaa = Glu,Lys
MDFWDPAVFXMCLWSLRNLFSRCSPCLTEISLHLVHLTAEKKQHGSNNGSA

SEQ ID NO: 3312 - protein, 38 aa, Homo Sapiens [sequence omitted]

SEQ ID NO: 3313 - protein, 47 aa, Homo Sapiens [sequence omitted]

SEQ ID NO: 3314 - protein, 79 aa, Homo Sapiens
  kidney
  SIGNAL -72..-1: Von Heijne matrix
  score 3.50
  seq WFYIGSSLNGTRG/KR
  UNSURE -33: Xaa = Ala,Gly
  UNSURE -38: Xaa = Cys,Asp,Gly,Asn,Ser,Tyr
MFGAAARSADLVLLEKNLQAAHGYAQEDRERMHRXIVSLXQNLLNFMIGSILDLWQCFLWFYIGSSLNGTRGKRVPAHF

SEQ ID NO: 3315 - protein, 30 aa, Homo Sapiens
  Heart
  SIGNAL -27..-1: Von Heijne matrix; score 3.50; seq VVALLIVCDVPSA/SA
MAARWRFWCVSVTMVVALLIVCDVPSASAR

SEQ ID NO: 3316 - protein, 64 aa, Homo Sapiens
  kidney
  SIGNAL -16..-1: Von Heijne matrix
  score 3.50
  seq LLLQPSMIQEVWT/XY
  UNSURE 1: Xaa =  * ,Leu,Ser
MVVLLLQPSMIQEVWTXYANLFHSFFVDNPFQKECFHQKNWYHITLMQRTVGTWRILPNFLKHD

SEQ ID NO: 3317 - protein, 86 aa, Homo Sapiens
  kidney
  SIGNAL -31..-1: Von Heijne matrix
  score 10.50
  seq LAVLLSLAPSASS/DI
  UNSURE -26: Xaa = His,Pro
  UNSURE 34: Xaa = Lys,Asn,Arg,Ser
MLHLHXSCLCFRSWLPAMLAVLLSLAPSASSDISASRPNILLLMADDLGIGDIGCYGNNTMRTPXIDRLAEDGVKLTQHISAASLC

SEQ ID NO: 3318 - protein, 29 aa, Homo Sapiens
  Substantia nigra
  SIGNAL -21..-1: Von Heijne matrix; score 14.30; seq LLLCAVLLSLASA/SS
MRVRIGLTLLLCAVLLSLASASSDEEGNG

SEQ ID NO: 3319 - protein, 36 aa, Homo Sapiens
  brain
  SIGNAL -28..-1: Von Heijne matrix; score 11.10; seq GLLFLLLLLMLLA/DP
MGLHLRPYRVGLLPDGLLFLLLLLMLLADPALPAAR

SEQ ID NO: 3320 - protein, 134 aa, Homo Sapiens
  brain
  SIGNAL -21..-1: Von Heijne matrix
  score 10.60
  seq LLLGAVSWPPASA/SG
  UNSURE 69: Xaa =  * ,Cys,Phe,Leu,Ser,Trp,Tyr
  UNSURE 74: Xaa = Ala,Gly,Pro,Arg
  UNSURE 70: Xaa = Asp,Asn
  UNSURE 61: Xaa = Ile,Val
MATLSFVFLLLGAVSWPPASASGQEFWPGQSAADILSGAASRRRYLLYDVNPPEGFNLRRDVYIRIASLLKTLLKTEEWVLXLPPWGRLXXWQSXDIHQVRIPWSEFFDLPSLNKNIPVIEYEQFIAESGGPFI

SEQ ID NO: 3321 - protein, 59 aa, Homo Sapiens [sequence omitted]

SEQ ID NO: 3322 - protein, 70 aa, Homo Sapiens
  Substantia nigra
  SIGNAL -21..-1: Von Heijne matrix; score 8.80; seq LLWALLFMQSLWP/QL
MWAMESGHLLWALLFMQSLWPQLTDGATRVYYLGIRDVQWNYAPKGRNVITNQPLDSDIVASSFLKSDDG

SEQ ID NO: 3323 - protein, 22 aa, Homo Sapiens
  brain
  SIGNAL -19..-1: Von Heijne matrix; score 8.70; seq ILGLLCCVLATMA/NP
MTHYRNILGLLCCVLATMANPG

SEQ ID NO: 3324 - protein, 27 aa, Homo Sapiens
  Substantia nigra
  SIGNAL -15..-1: Von Heijne matrix
  score 8.40
  seq LLLLLASLIERSS/KT
  UNSURE 6: Xaa =  * ,Gly,Arg
  UNSURE 5: Xaa =  * ,Phe,Leu,Tyr
MKLLLLLASLIERSSKTSCXXQHYSSQ

SEQ ID NO: 3325 - protein, 52 aa, Homo Sapiens
  Substantia nigra
  SIGNAL -38..-1: Von Heijne matrix
  score 8.20
  seq SFXLFLALCASFS/FF
  UNSURE 4: Xaa = Cys,Phe
  UNSURE -11: Xaa = Leu,Trp
MARNQALVCLPSFQNAFIPVEDLPTSFXLFLALCASFSFFLXLSLSLPSFFF

SEQ ID NO: 3326 - protein, 41 aa, Homo Sapiens [sequence omitted]

SEQ ID NO: 3327 - protein, 39 aa, Homo Sapiens [sequence omitted]

SEQ ID NO: 3328 - protein, 80 aa, Homo Sapiens
  brain
  SIGNAL -73..-1: Von Heijne matrix
  score 7.80
  seq YLPLLAGLGLTLA/AP
  UNSURE -14: Xaa =  * ,Gly,Arg
  UNSURE -60: Xaa = Glu,Gly
MALGEEKAEAEASXDTKAQSYGRGSCRERELDIPGPMSGEQPPRLEAEGGLISPVWGAEXYLPLLAGLGLTLAAPLEPTT

SEQ ID NO: 3329 - protein, 41 aa, Homo Sapiens [sequence omitted]

SEQ ID NO: 3330 - protein, 58 aa, Homo Sapiens [sequence omitted]

SEQ ID NO: 3331 - protein, 78 aa, Homo Sapiens
  Substantia nigra
  SIGNAL -48..-1: Von Heijne matrix
  score 7.50
  seq FVILLLFIFTVVS/LV
  UNSURE 12: Xaa = Asp,Glu
  UNSURE 13: Xaa = Cys,Ser
MASSHWNETTTSVYQYLGFQVQKIYPFHDNWNTACFVILLLFIFTVVSLVVLAFLYEVLXXCCCVKNKTVKDLKSEPK

SEQ ID NO: 3332 - protein, 44 aa, Homo Sapiens
  brain
  SIGNAL -25..-1: Von Heijne matrix
  score 7.40
  seq IFLLNMWVACLLS/GE
  UNSURE 10: Xaa = Ile,Leu
  UNSURE 9: Xaa = Lys,Asn
MSLLFVFCLECSIFLLNMWVACLLSGEIPHSSWXXKLIGTLPTS

SEQ ID NO: 3333 - protein, 32 aa, Homo Sapiens
  Substantia nigra
  SIGNAL -18..-1: Von Heijne matrix
  score 7.40
  seq VLLLLPLVAFITL/KF
  UNSURE 11: Xaa = His,Leu,Gln
MFVVTVLLLLPLVAFITLKFCNLINFPTXRHG

SEQ ID NO: 3334 - protein, 67 aa, Homo Sapiens
  Substantia nigra
  SIGNAL -22..-1: Von Heijne matrix; score 7.20; seq IIYALQFLFLVFA/PS
MNRSCRNTGIIYALQFLFLVFAPSSLGYFEWIVAINQDLVLFVFCLSFSLRISIIQGKRKAAFPTPP

SEQ ID NO: 3335 - protein, 45 aa, Homo Sapiens
  Cerebellum
  SIGNAL -35..-1: Von Heijne matrix; score 7.20; seq LSLLLAWVTLTHL/LS
MTQTTWGAPTRASNHPLPAWLTLSLLLAWVTLTHLLSVLTHPTLL

SEQ ID NO: 3336 - protein, 85 aa, Homo Sapiens
  Substantia nigra
  SIGNAL -16..-1: Von Heijne matrix
  score 7.10
  seq XXAVLCVCAAAWC/SQ
  UNSURE -12: Xaa =  * ,Ala,Glu,Gly,Ile,Lys,Leu,Pro,Gln,Arg,Ser,Thr,Val
  UNSURE 13: Xaa = Ala,Ser,Thr
  UNSURE -13: Xaa = Asp,Glu,Gly,Val
  UNSURE 66: Xaa = Pro,Arg
MLKXXAVLCVCAAAWCSQSLAAAAAVAAXGGRSDGGNFLDDKQWLTTISQYDKEVGQWNKFRDDDYFRTWSPGKPFDQALDXANG

SEQ ID NO: 3337 - protein, 22 aa, Homo Sapiens
  brain
  SIGNAL -20..-1: Von Heijne matrix; score 6.90; seq LHLLGSSISPASA/SL
MISAHCNLHLLGSSISPASASL

SEQ ID NO: 3338 - protein, 55 aa, Homo Sapiens
  Substantia nigra
  SIGNAL -28..-1: Von Heijne matrix
  score 6.90
  seq FLPFLLSLPLDQT/LP
  UNSURE -26: Xaa = Ala,Pro
  UNSURE -15: Xaa = Asp,Glu
  UNSURE -27: Xaa = Cys,Phe
MXXKACRTLAWLPXPFLPFLLSLPLDQTLPRQGPGQSLSFPENYQTLPKSTRHPG

SEQ ID NO: 3339 - protein, 58 aa, Homo Sapiens [sequence omitted]

SEQ ID NO: 3340 - protein, 119 aa, Homo Sapiens
  Substantia nigra
  SIGNAL -83..-1: Von Heijne matrix
  score 6.80
  seq LLMILTFPFKILS/DA
  UNSURE 24: Xaa = Ala,Gly,Arg,Thr
  UNSURE 23: Xaa = Cys,Phe,Gly,Val
MQAVDNLTSAPGNTSLCTRDYKITQVLFPLLYTVLFFVGLITNGLAMRIFFQIRSKSNFIIFLKNTVISDLLMILTFPFKILSDAKLGTGPLRTFVCQVTSVIFYXXMYISISFLGLIT

SEQ ID NO: 3341 - protein, 55 aa, Homo Sapiens
  Substantia nigra
  SIGNAL -36..-1: Von Heijne matrix
  score 6.80
  seq LWFFLPSLXCPEC/CP
  UNSURE -5: Xaa = His,Pro
MWTLPSLSASFQPFLGSLRPSHILWFFLPSLXCPECCPPDPGSPASRDPNVACER

SEQ ID NO: 3342 - protein, 84 aa, Homo Sapiens [sequence omitted]

SEQ ID NO: 3343 - protein, 72 aa, Homo Sapiens
  Substantia nigra
  SIGNAL -17..-1: Von Heijne matrix; score 6.60; seq LAFLLVSLYWSHM/HP
MDWSLAFLLVSLYWSHMHPCYWSWPCSCGFVDSPCICTASTRCCCSSLCCLWRLALWDWTSNGSRSGIACVC

SEQ ID NO: 3344 - protein, 19 aa, Homo Sapiens [sequence omitted]

SEQ ID NO: 3345 - protein, 56 aa, Homo Sapiens [sequence omitted]

SEQ ID NO: 3346 - protein, 41 aa, Homo Sapiens
  Substantia nigra
  SIGNAL -24..-1: Von Heijne matrix; score 6.50; seq FLILLSIDSLVSG/FL
MLILELTMMLSFLILLSIDSLVSGFLSKRKGLRVCDGSRSG

SEQ ID NO: 3347 - protein, 56 aa, Homo Sapiens [sequence omitted]

SEQ ID NO: 3348 - protein, 20 aa, Homo Sapiens [sequence omitted]

SEQ ID NO: 3349 - protein, 34 aa, Homo Sapiens [sequence omitted]

SEQ ID NO: 3350 - protein, 35 aa, Homo Sapiens
  brain
  SIGNAL -16..-1: Von Heijne matrix; score 5.70; seq LVCGFLQISLSLA/SL
MTRLVCGFLQISLSLASLFLTIPLMWYMQSKWWRG

SEQ ID NO: 3351 - protein, 20 aa, Homo Sapiens
  brain
  SIGNAL -15..-1: Von Heijne matrix; score 5.60; seq FLLPLLLHHLTFH/GR
MNFLLPLLLHHLTFHGRPLK

SEQ ID NO: 3352 - protein, 81 aa, Homo Sapiens
  Substantia nigra
  SIGNAL -58..-1: Von Heijne matrix
  score 5.50
  seq LIIFICXTASISA/YM
  UNSURE -7: Xaa = Phe,Ile,Val
MLSARDRRDRHPEEGVVAELQGFAVDKAFLTSHKGILLETELALTLIIFICXTASISAYMAAALLEFFITLAFLFLYATPA

SEQ ID NO: 3353 - protein, 38 aa, Homo Sapiens
  brain
  SIGNAL -13..-1: Von Heijne matrix; score 5.50; seq MLTMSVTLSPLRS/QD
MLTMSVTLSPLRSQDLDPMATDASPMAINMTPTVEQGL

SEQ ID NO: 3354 - protein, 60 aa, Homo Sapiens
  brain
  SIGNAL -46..-1: Von Heijne matrix
  score 5.40
  seq FFLLISSVRPISQ/TF
  UNSURE -44: Xaa = Ile,Met
  UNSURE -17: Xaa = Phe,Ile,Leu,Val
MFXPVALIFPISVSDPTIHPITQAQNLESXLQSFFLLISSVRPISQTFKIDLSPSVRATG

SEQ ID NO: 3355 - protein, 34 aa, Homo Sapiens
  Substantia nigra
  SIGNAL -31..-1: Von Heijne matrix; score 5.40; seq WCAVLRSWLAASS/AP
MLLFFPFFGETVSLHHPCWCAVLRSWLAASSAPR

SEQ ID NO: 3356 - protein, 56 aa, Homo Sapiens [sequence omitted]

SEQ ID NO: 3357 - protein, 70 aa, Homo Sapiens
  brain
  SIGNAL -19..-1: Von Heijne matrix
  score 5.40
  seq LSHLLPSLRQVIQ/EP
  UNSURE 32: Xaa =  * ,Tyr
  UNSURE 10: Xaa = Leu,Met,Pro,Thr
MAMAQKLSHLLPSLRQVIQEPQLSLQPEXVFTVDRAEVPPLFWKPYIYAGXRPLHQTWRFYFRTLFQQHN

SEQ ID NO: 3358 - protein, 74 aa, Homo Sapiens
  brain
  SIGNAL -28..-1: Von Heijne matrix
  score 5.40
  seq LALVALAPHSVQK/SX
  UNSURE 17: Xaa = Ala,Glu,Val
  UNSURE 29: Xaa = Ala,Pro
  UNSURE 3: Xaa = Ala,Pro,Thr
  UNSURE 2: Xaa = Phe,Leu,Ser
MIAPTLKGTPSSSAPLALVALAPHSVQKSXXFPPNLLTSPPSVAXAESGSVITLSAXIAPSEPKTNLNKVPSEV

SEQ ID NO: 3359 - protein, 41 aa, Homo Sapiens
  brain
  SIGNAL -37..-1: Von Heijne matrix
  score 5.30
  seq LVESLCLVFNLLS/LP
  UNSURE -20: Xaa = Arg,Thr
  UNSURE -19: Xaa = Leu,Val
MCLFPVSPCPAYSFSSEXXGAVLLLVESLCLVFNLLSLPPR

SEQ ID NO: 3360 - protein, 91 aa, Homo Sapiens
  brain
  SIGNAL -15..-1: Von Heijne matrix; score 5.30; seq IAVLFCFLLLIIF/QT
MKIAVLFCFLLLIIFQTDFGKNEEIPRKQRRKIYHRRLRKSSTSHKHRSNRQLGIPQTTVFTPVARLPIVNFDYSMEEKFESFSSFPGVES

SEQ ID NO: 3361 - protein, 30 aa, Homo Sapiens [sequence omitted]

SEQ ID NO: 3362 - protein, 69 aa, Homo Sapiens [sequence omitted]

SEQ ID NO: 3363 - protein, 64 aa, Homo Sapiens
  brain
  SIGNAL -26..-1: Von Heijne matrix; score 5.10; seq LLTLYVFVASSMQ/IY
MKTTYVIFMQSKALLTLYVFVASSMQIYVLHISNYPTDEHFPIIKHFYFTFKIHFSKIIYVQYS

SEQ ID NO: 3364 - protein, 25 aa, Homo Sapiens [sequence omitted]

SEQ ID NO: 3365 - protein, 35 aa, Homo Sapiens [sequence omitted]

SEQ ID NO: 3366 - protein, 62 aa, Homo Sapiens
  brain
  SIGNAL -57..-1: Von Heijne matrix; score 5.10; seq VGSVCCCVGPLRG/LV
MGRGWERTVCSLGWRGGPDPLSWATCWSGARSRHTRVSSIVNGYVGSVCCCVGPLRGLVWAP

SEQ ID NO: 3367 - protein, 27 aa, Homo Sapiens
  Substantia nigra
  SIGNAL -22..-1: Von Heijne matrix; score 5.00; seq HLFVTWSSQRALS/HP
MPEAVEQSAHLFVTWSSQRALSHPAPL

SEQ ID NO: 3368 - protein, 49 aa, Homo Sapiens
  Cerebellum
  SIGNAL -24..-1: Von Heijne matrix
  score 5.00
  seq CWLIALSVPLVFW/VT
  UNSURE 20: Xaa = Ala,Thr
MPGTHTFTFKSCWLIALSVPLVFWVTFWPCNFYPSLDFCMLTKXKSIFI

SEQ ID NO: 3369 - protein, 43 aa, Homo Sapiens [sequence omitted]

SEQ ID NO: 3370 - protein, 55 aa, Homo Sapiens [sequence omitted]

SEQ ID NO: 3371 - protein, 53 aa, Homo Sapiens
  Substantia nigra
  SIGNAL -16..-1: Von Heijne matrix; score 4.90; seq FIYLQAHFTLCSG/WS
MVPFIYLQAHFTLCSGWSSTYRDLRKGVYVPYTQGKWEGELGTDLVSIPHGPK

SEQ ID NO: 3372 - protein, 30 aa, Homo Sapiens [sequence omitted]

SEQ ID NO: 3373 - protein, 23 aa, Homo Sapiens [sequence omitted]

SEQ ID NO: 3374 - protein, 42 aa, Homo Sapiens [sequence omitted]

SEQ ID NO: 3375 - protein, 42 aa, Homo Sapiens [sequence omitted]

SEQ ID NO: 3376 - protein, 36 aa, Homo Sapiens [sequence omitted]

SEQ ID NO: 3377 - protein, 92 aa, Homo Sapiens
  Surrenals
  SIGNAL -69..-1: Von Heijne matrix; score 4.70; seq SLLCLAFLLGRFL/HM
MMHNIIVKELIVTFFLGITVVQMLISVTGLKGVEAQNGSESEVFVGKYETLVFYWPSLLCLAFLLGRFLHMFVKALRVHLGWELQVEEKSVL

SEQ ID NO: 3378 - protein, 102 aa, Homo Sapiens
  Substantia nigra
  SIGNAL -27..-1: Von Heijne matrix; score 4.60; seq RLLCSRLCQQLRS/KR
MSNCLQNFLKITSTRLLCSRLCQQLRSKRKFFGTVPISRLHRRVVITGIGLVTPLGVGTHLVWDRLIGGESGIVSLVGEEYKSIPCSVAAYVPRGSDEGQSG

SEQ ID NO: 3379 - protein, 56 aa, Homo Sapiens
  Cerebellum
  SIGNAL -16..-1: Von Heijne matrix
  score 4.60
  seq XGLFLRTTAAARA/CR
  UNSURE -13: Xaa = Ala,Pro,Ser,Thr
  UNSURE 33: Xaa = Glu,Lys
MSGXGLFLRTTAAARACRGLVVSTANRRLLRTSPPVRAFAKELFLGKIXKVTRALG

SEQ ID NO: 3380 - protein, 32 aa, Homo Sapiens [sequence omitted]

SEQ ID NO: 3381 - protein, 42 aa, Homo Sapiens [sequence omitted]

SEQ ID NO: 3382 - protein, 48 aa, Homo Sapiens [sequence omitted]

SEQ ID NO: 3383 - protein, 32 aa, Homo Sapiens
  Substantia nigra
  SIGNAL -30..-1: Von Heijne matrix; score 4.50; seq IAALLGLLQLRFK/AE
MQAASFGRGRNGLDNWGIAALLGLLQLRFKAE

SEQ ID NO: 3384 - protein, 52 aa, Homo Sapiens
  Substantia nigra
  SIGNAL -43..-1: Von Heijne matrix; score 4.50; seq ENLLLCCHRCTNC/QR
MSPSLGDRCSSWLHLVSHLESISGPLLNIPENLLLCCHRCTNCQRHHFCSVW

SEQ ID NO: 3385 - protein, 47 aa, Homo Sapiens
  Cerebellum
  SIGNAL -24..-1: Von Heijne matrix; score 4.40; seq YFLLPCLINLAIG/VK
MSGAEPTTFIRYFLLPCLINLAIGVKWKTAWKRGERQLNNTVFFFFF

SEQ ID NO: 3386 - protein, 32 aa, Homo Sapiens [sequence omitted]

SEQ ID NO: 3387 - protein, 24 aa, Homo Sapiens
  brain
  SIGNAL -14..-1: Von Heijne matrix; score 4.30; seq LFLCSCSLSLNQL/LT
MLFLCSCSLSLNQLLTYIFVVPPW

SEQ ID NO: 3388 - protein, 22 aa, Homo Sapiens [sequence omitted]

SEQ ID NO: 3389 - protein, 41 aa, Homo Sapiens
  Substantia nigra
  SIGNAL -29..-1: Von Heijne matrix; score 4.20; seq FLSHVTTSLASSS/AP
MLPLQGLCTCYFLHLEFLSHVTTSLASSSAPSPKPSVTLSS

SEQ ID NO: 3390 - protein, 24 aa, Homo Sapiens [sequence omitted]

SEQ ID NO: 3391 - protein, 40 aa, Homo Sapiens
  Substantia nigra
  SIGNAL -29..-1: Von Heijne matrix; score 4.10; seq LWASQGSLQDAQS/ER
MRWNLFFFCILRNQTKLWASQGSLQDAQSERGCFSLNQDG

SEQ ID NO: 3392 - protein, 32 aa, Homo Sapiens
  brain
  SIGNAL -14..-1: Von Heijne matrix; score 4.10; seq FIAALFTMAKTWN/QP
MFIAALFTMAKTWNQPGCSSMMGWIKKMRHMT

SEQ ID NO: 3393 - protein, 61 aa, Homo Sapiens
  brain
  SIGNAL -44..-1: Von Heijne matrix
  score 4.10
  seq LWVXLPXXXVIAS/VV
  UNSURE -5: Xaa = Ala,Val
  UNSURE -23: Xaa = Gly,Trp
  UNSURE 6: Xaa = Gly,Val
  UNSURE -22: Xaa = His,Lys,Asn,Gln
  UNSURE -29: Xaa = Leu,Met,Arg
  UNSURE -32: Xaa = Lys,Thr
  UNSURE -6: Xaa = Met,Val
  UNSURE -7: Xaa = Phe,Leu
  UNSURE -41: Xaa = Pro,Ser
  UNSURE -10: Xaa = Ser,Trp
MPGXKHFLRVFRXSAXRSVGYXXKPGTSRASLWVXLPXXXVIASVVTFSXHMTLGFDLTAA

SEQ ID NO: 3394 - protein, 80 aa, Homo Sapiens
  Surrenals
  SIGNAL -49..-1: Von Heijne matrix; score 4.10; seq VALGPLFVTGHFA/GE
MRLESPDENFAVVQEHAIHHIDGPLRRFLLLEVHEPVALGPLFVTGHFAGEDVAERREDVVQRLVVDGLAQVLDEDVAHP

SEQ ID NO: 3395 - protein, 25 aa, Homo Sapiens [sequence omitted]

SEQ ID NO: 3396 - protein, 63 aa, Homo Sapiens
  brain
  SIGNAL -52..-1: Von Heijne matrix; score 4.00; seq RHLFLFEISLVFS/KE
MHVSMLEGFDENLDVQGELILQDAFQVWDPKSLIRKGRERHLFLFEISLVFSKEIKDSSEHNG

SEQ ID NO: 3397 - protein, 65 aa, Homo Sapiens
  Substantia nigra
  SIGNAL -39..-1: Von Heijne matrix
  score 3.90
  seq VLAIGLLHIVLLS/IP
  UNSURE -21: Xaa = Ala,Asp,Gly,Val
  UNSURE -28: Xaa = His,Leu,Pro,Arg
  UNSURE 7: Xaa = Pro,Arg
MNVGTAHSEVNXNTRVMKXRGIWLSYVLAIGLLHIVLLSIPFVSVXVVWTLTNLIHNMGMYIFLH

SEQ ID NO: 3398 - protein, 21 aa, Homo Sapiens
  brain
  SIGNAL -16..-1: Von Heijne matrix
  score 3.80
  seq FVXAIXXYIPTNS/VQ
  UNSURE -8: Xaa =  * ,Glu,Gly,Leu,Val
  UNSURE -11: Xaa = Leu,Met,Val
  UNSURE -7: Xaa = Phe,Ile,Leu,Val
MLSFVXAIXXYIPTNSVQEFL

SEQ ID NO: 3399 - protein, 40 aa, Homo Sapiens
  Substantia nigra
  SIGNAL -32..-1: Von Heijne matrix; score 3.80; seq TFINITLWLGSLC/QR
MDEYSWWCHVLEVVKGQMFTFINITLWLGSLCQRFFYASG

SEQ ID NO: 3400 - protein, 29 aa, Homo Sapiens [sequence omitted]

SEQ ID NO: 3401 - protein, 31 aa, Homo Sapiens [sequence omitted]

SEQ ID NO: 3402 - protein, 78 aa, Homo Sapiens
  brain
  SIGNAL -64..-1: Von Heijne matrix
  score 3.80
  seq LFIVVCVICVTLN/FP
  UNSURE 4: Xaa =  * ,Phe,Leu,Ser,Tyr
  UNSURE 5: Xaa = Asp,Tyr
MTPRILSEVQFSAFCPYWTIARILERVGSACFRLELCAAIVGYFVLDVRTFLFIVVCVICVTLNFPRXXFLCLSSLTA

SEQ ID NO: 3403 - protein, 67 aa, Homo Sapiens
  Substantia nigra
  SIGNAL -14..-1: Von Heijne matrix
  score 3.70
  seq CSLLSGWGQLLRC/VQ
  UNSURE 14: Xaa = Leu,Pro,Arg
MCSLLSGWGQLLRCVQTPAEPRDVNKKXEKKEKYMPLVDSLCGGLGTRNSDCLRGGAGRGRDGRRIR

SEQ ID NO: 3404 - protein, 46 aa, Homo Sapiens
  Cerebellum
  SIGNAL -37..-1: Von Heijne matrix; score 3.70; seq LIPFNFSASGLCA/CS
MLFSFCFPVHFWNPSSLFPPSSVSLIPFNFSASGLCACSRTFTHMG

SEQ ID NO: 3405 - protein, 27 aa, Homo Sapiens
  brain
  SIGNAL -15..-1: Von Heijne matrix
  score 3.60
  seq WILRILFVIGSXL/EK
  UNSURE -2: Xaa = Lys,Asn,Arg,Ser
MTWILRILFVIGSXLEKLWNILVSYIF

SEQ ID NO: 3406 - protein, 56 aa, Homo Sapiens
  Substantia nigra
  SIGNAL -48..-1: Von Heijne matrix
  score 3.60
  seq ILCIFLGLLIIRC/FK
  UNSURE 6: Xaa = Ala,Asp,Glu,Gly,Val
MSSTYCGNSSAKMSVNEVSAFSLSLEQKTGFAFVGILCIFLGLLIIRCFKILLXQS

SEQ ID NO: 3407 - protein, 22 aa, Homo Sapiens
  Substantia nigra
  SIGNAL -18..-1: Von Heijne matrix; score 3.60; seq LTMLSMIVGATCY/AM
MTDIWLTMLSMIVGATCYAMIG

SEQ ID NO: 3408 - protein, 52 aa, Homo Sapiens
  Substantia nigra
  SIGNAL -17..-1: Von Heijne matrix
  score 3.60
  seq WIYAFISLGYILG/SG
  UNSURE -16: Xaa = Arg,Ser
  UNSURE -15: Xaa = Phe,Ile,Leu,Val
MXXCWIYAFISLGYILGSGIVGLFGNFMFKLLRNCQTVFQDGYAILPFPPTG

SEQ ID NO: 3409 - protein, 46 aa, Homo Sapiens
  Substantia nigra
  SIGNAL -31..-1: Von Heijne matrix
  score 3.50
  seq QLALSWVPPXCRV/SP
  UNSURE -4: Xaa = Asp,Gly,Asn,Ser
MFIRTLKTTVLPFMRTAPQLALSWVPPXCRVSPWDSPLKLYCLQPQ

SEQ ID NO: 3410 - protein, 29 aa, Homo Sapiens [sequence omitted]

SEQ ID NO: 3411 - protein, 55 aa, Homo Sapiens
  Substantia nigra
  SIGNAL -23..-1: Von Heijne matrix
  score 3.50
  seq EGLELGFSHRTFA/FP
  UNSURE 15: Xaa =  * ,Cys,Phe,Leu,Ser,Trp,Tyr
MIVIPSWLENEGLELGFSHRTFAFPVTHASSQYIWMNXLTRTTVAISVYFWTHTG

SEQ ID NO: 3412 - protein, 48 aa, Homo Sapiens
  brain
  SIGNAL -43..-1: Von Heijne matrix; score 3.50; seq VISVFLSFLPSYP/GF
MLKKEIAHHSPSLVSCPVCTTKYRTLRLLRVISVFLSFLPSYPGFSMQ

SEQ ID NO: 3413 - protein, 32 aa, Homo Sapiens
  Substantia nigra
  SIGNAL -30..-1: Von Heijne matrix
  score 3.50
  seq CAYSLPGVALTLG/RQ
  UNSURE -19: Xaa = Arg,Ser,Thr
  UNSURE -28: Xaa = Asp,Glu,Gly
MTXPSRAQTVDXGIAKHCAYSLPGVALTLGRQ

SEQ ID NO: 3414 - protein, 27 aa, Homo Sapiens
  Substantia nigra
  SIGNAL -21..-1: Von Heijne matrix
  score 9.80
  seq LGLLCALLPQHHG/AP
  UNSURE 6: Xaa = Gly,Trp
MPFRLLIPLGLLCALLPQHHGAPGPDX

SEQ ID NO: 3415 - protein, 37 aa, Homo Sapiens
  Cerebellum
  SIGNAL -18..-1: Von Heijne matrix
  score 9.20
  seq VFLCSLLAPMVLA/SA
  UNSURE 8,10: Xaa = Asp,Glu
  UNSURE -17: Xaa = Glu,Gln
  UNSURE 7: Xaa = Glu,Lys
MXLVLVFLCSLLAPMVLASAAEKEXXMXPFHYDYQTL

SEQ ID NO: 3416 - protein, 89 aa, Homo Sapiens
  Substantia nigra
  SIGNAL -30..-1: Von Heijne matrix; score 9.00; seq FFLLLLFRGCLIG/AV
MALRRPPRLRLCARLPDFFLLLLFRGCLIGAVNLKSSNRTPVVQEFESVELSCIITDSQTSDPRIEWKKIQDEQTTYVFFDNKIQGDLA

SEQ ID NO: 3417 - protein, 113 aa, Homo Sapiens
  Substantia nigra
  SIGNAL -60..-1: Von Heijne matrix
  score 7.20
  seq VLLTLLLIAFIFL/II
  UNSURE 44: Xaa =  * ,Cys,Asp,Glu,Gly,His,Lys,Asn,Gln,Arg,Ser,Trp,Tyr
  UNSURE 45: Xaa =  * ,Cys,Phe,Ile,Leu,Arg,Ser,Thr
  UNSURE 24: Xaa = Ala,Glu,Gly,Lys,Leu,Met,Pro,Gln,Arg,Thr,Val
  UNSURE 27: Xaa = Cys,Phe,Leu,Ser,Trp
  UNSURE 3: Xaa = Ile,Met,Arg,Ser,Thr
MGGNGSTCKPDTERQGTLSTAAPTTSPAPCLSNHHNKKHLILAFCAGVLLTLLLIAFIFLIIXSYRKYHSKPQAPDPHSDPPAXLSXIPGEITYLCQHNFQTLXXKRAITWLR

SEQ ID NO: 3418 - protein, 97 aa, Homo Sapiens
  Cerebellum
  SIGNAL -39..-1: Von Heijne matrix
  score 7.20
  seq SALAKLLLTCCSA/LR
  UNSURE 41: Xaa =  * ,Tyr
  UNSURE 32,44: Xaa = Ile,Leu
  UNSURE 28: Xaa = Leu,Met,Val
MGTADSDEMAPEAPQHTHIDVHIHQESALAKLLLTCCSALRPRATQARGSSRLLVASWVMQIVLGIXSAVXGGFFYIRDXTLXVTSGAAIWTGAVAV

SEQ ID NO: 3419 - protein, 21 aa, Homo Sapiens [sequence omitted]

SEQ ID NO: 3420 - protein, 80 aa, Homo Sapiens
  Cerebellum
  SIGNAL -43..-1: Von Heijne matrix; score 4.20; seq WWCCPARLTLTSG/WP
MARSPLRRRGRPTWSLSTPRPGSPTSSSRSWWCCPARLTLTSGWPATPRRFSTTSTCSIAPSRSSAQERRVRRWPCATHS

SEQ ID NO: 3421 - protein, 37 aa, Homo Sapiens [sequence omitted]

SEQ ID NO: 3422 - protein, 40 aa, Homo Sapiens
  Substantia nigra
  SIGNAL -37..-1: Von Heijne matrix; score 3.70; seq FLGVLALLGYLAV/RP
MLMPVVGRGNGIPQTVSEWLRLLPFLGVLALLGYLAVRPG

SEQ ID NO: 3423 - protein, 79 aa, Homo Sapiens
  Cerebellum
  SIGNAL -49..-1: Von Heijne matrix; score 3.60; seq PPFFLCLQCFTRG/FE
MDRLGSFSNDPSDKPPCRGCSSYLMEPYIKCAECGPPPFFLCLQCFTRGFEYKKHQSDHTYEIMAGCSQSNVHQDQGGQ

SEQ ID NO: 3424 - protein, 111 aa, Homo Sapiens
  Cerebellum
  SIGNAL -87..-1: Von Heijne matrix
  score 3.60
  seq GLLLLYMVYLTLV/EP
  UNSURE 20: Xaa = Asp,Asn
  UNSURE 5: Xaa = Glu,Lys,Gln
MSDVNVSALPIKKNSGHIYNKNISQKDCDCLHVVEPMPVRGPDVEAYCLRCECKYEERSSVTIKVTIIIYLSILGLLLLYMVYLTLVEPILXRRLFGHAQLIQSDDXIGGL

SEQ ID NO: 3425 - protein, 48 aa, Homo Sapiens
  Cerebellum
  SIGNAL -46..-1: Von Heijne matrix
  score 3.50
  seq ALSLSLSMAPPNP/GP
  UNSURE -44: Xaa = Asp,Glu
MAXCRRCRSQRRSHCCQDRRLRRPRLTLWRHHTALSLSLSMAPPNPGP

SEQ ID NO: 3426 - protein, 96 aa, Homo Sapiens
  Substantia nigra
  SIGNAL -36..-1: Von Heijne matrix
  score 3.50
  seq LALTALSVXRKXS/XX
  UNSURE 5: Xaa =  * ,Cys,Phe,Leu,Trp
  UNSURE 12: Xaa =  * ,Leu,Ser
  UNSURE -5: Xaa = Ala,Gly
  UNSURE 1: Xaa = Asn,Ser
  UNSURE 3: Xaa = Asp,Glu,Lys,Asn
  UNSURE 6: Xaa = Glu,Lys
  UNSURE 2: Xaa = Gly,Val
  UNSURE 4: Xaa = Leu,Arg,Trp
  UNSURE -2: Xaa = Phe,Leu
MTRLGGKGGQQFPPGQKIISKDILALTALSVXRKXSXXXXXXTSKETXDNQDSVKENREKDLLDIIKGTKVELSTVNVQTTKPPNRSSLKSYNWRA

SEQ ID NO: 3427 - protein, 24 aa, Homo Sapiens
  Substantia nigra
  SIGNAL -20..-1: Von Heijne matrix; score 12.40; seq ALLLGALLGTAWA/RR
MKGWGWLALLLGALLGTAWARRSR

SEQ ID NO: 3428 - protein, 45 aa, Homo Sapiens [sequence omitted]

SEQ ID NO: 3429 - protein, 128 aa, Homo Sapiens
  Substantia nigra
  SIGNAL -22..-1: Von Heijne matrix
  score 11.10
  seq QLLALFFLPFCLC/QD
  UNSURE 103: Xaa = Ala,Glu
MLWRQLIYWQLLALFFLPFCLCQDEYMESPQTGGLPPDCSKCCHGDYSFRGYQGPPGPPGPPGIPGNHGNNGNNGATGHEGAKGEKGDKGDLGPRGERGQHGPKGEKGYPGIPPELQIAFMASLXPTS

SEQ ID NO: 3430 - protein, 37 aa, Homo Sapiens
  Substantia nigra
  SIGNAL -17..-1: Von Heijne matrix
  score 9.20
  seq LLLLVAASAMVRS/XA
  UNSURE 1: Xaa = Asp,Glu
MRLLLLLLVAASAMVRSXASANLGGVPSKRLKMQYTT

SEQ ID NO: 3431 - protein, 132 aa, Homo Sapiens
  Substantia nigra
  SIGNAL -25..-1: Von Heijne matrix
  score 9.00
  seq ALLVLLGVAASLC/VR
  UNSURE 64: Xaa = Ala,Asp
  UNSURE 88: Xaa = Ala,Cys,Asp,Gly,His,Asn,Pro,Arg,Ser,Thr,Tyr
  UNSURE -21: Xaa = Ala,Thr
  UNSURE 70: Xaa = Gly,Val
  UNSURE 59: Xaa = His,Tyr
  UNSURE 73: Xaa = Ile,Leu
  UNSURE 87: Xaa = Ile,Lys,Met,Asn,Arg,Ser,Thr
  UNSURE 71: Xaa = Pro,Thr
MSSGXELLWPGAALLVLLGVAASLCVRCSRPGAKRSEKIYQQRSLREDQQSFTGSRTYSLVGQAWPGPLADMAPTRKDKLLQFXPSLEXPSIFQXXEXQPVCVCAAHAQVQXXQRKSTSREVCVRTNRALRG

SEQ ID NO: 3432 - protein, 125 aa, Homo Sapiens
  brain
  SIGNAL -78..-1: Von Heijne matrix; score 8.80; seq SCLGLTLMPFASS/FP
MTKEIFFFTVELVCENKELCSSPRWRNAIQKSNFSKVTSFFMSCHHFKGLAPLPHVYTQGNCRPISCLGLTLMPFASSFPEVKVPVMYSHRNIFQLFMSFTTKKKIQSGWSTTLSIFLVRNFLLI

SEQ ID NO: 3433 - protein, 29 aa, Homo Sapiens
  Substantia nigra
  SIGNAL -21..-1: Von Heijne matrix; score 7.50; seq YFRALCLPRGAWG/FP
MTTDIGCLYFRALCLPRGAWGFPSLQIKG

SEQ ID NO: 3434 - protein, 25 aa, Homo Sapiens [sequence omitted]

SEQ ID NO: 3435 - protein, 56 aa, Homo Sapiens
  Substantia nigra
  SIGNAL -15..-1: Von Heijne matrix
  score 7.00
  seq LRLLKLAATSASA/RV
  UNSURE 4: Xaa = Ala,Glu,Lys,Thr
  UNSURE 6: Xaa = Asp,Glu,Gly
MALRLLKLAATSASARVVXAXAQRVRGIHSSVQCKLRYGMWHFLLGDKASKRLTVQ

SEQ ID NO: 3436 - protein, 44 aa, Homo Sapiens
  Substantia nigra
  SIGNAL -20..-1: Von Heijne matrix
  score 6.90
  seq VLLFLYSVLLTKG/IE
  UNSURE 24: Xaa = Asn,Ser
MWGNKFGVLLFLYSVLLTKGIENIKNEIEDASEPLIDPVYGHGX

SEQ ID NO: 3437 - protein, 44 aa, Homo Sapiens
  Substantia nigra
  SIGNAL -27..-1: Von Heijne matrix; score 6.80; seq VFVCSSVLGQSWG/GF
MYTFRKLSPYLNKIVFVCSSVLGQSWGGFFSNLSETLSATLFNG

SEQ ID NO: 3438 - protein, 23 aa, Homo Sapiens
  brain
  SIGNAL -21..-1: Von Heijne matrix; score 6.40; seq TFCLIFGLGAVWG/LV
MESRVLLRTFCLIFGLGAVWGLV

SEQ ID NO: 3439 - protein, 62 aa, Homo Sapiens [sequence omitted]

SEQ ID NO: 3440 - protein, 50 aa, Homo Sapiens
  Substantia nigra
  SIGNAL -32..-1: Von Heijne matrix; score 6.30; seq TVVLCVGCSTVLC/QP
MDVKCPGCYKITTVFSHAQTVVLCVGCSTVLCQPTGGKARLTEGCSFRRK

SEQ ID NO: 3441 - protein, 22 aa, Homo Sapiens [sequence omitted]

SEQ ID NO: 3442 - protein, 70 aa, Homo Sapiens
  Surrenals
  SIGNAL -60..-1: Von Heijne matrix; score 5.90; seq TWLLLGALEPASE/RP
MLVVEASSSVRLASSEVTSWSILVTPSASTPIISLSAGPLRTPSHSKTWLLLGALEPASERPCSSVLRSR

SEQ ID NO: 3443 - protein, 35 aa, Homo Sapiens
  brain
  SIGNAL -27..-1: Von Heijne matrix; score 5.70; seq LSLQLIAFPTVSC/EI
MYSFPTTVVEEILSLSLQLIAFPTVSCEILLEITR

SEQ ID NO: 3444 - protein, 20 aa, Homo Sapiens
  brain
  SIGNAL -16..-1: Von Heijne matrix; score 5.60; seq LLPLRSLLALVRE/SR
MLMLLPLRSLLALVRESRAR

SEQ ID NO: 3445 - protein, 103 aa, Homo Sapiens
  Cerebellum
  SIGNAL -25..-1: Von Heijne matrix
  score 5.50
  seq AQLFACLLRLGTQ/QV
  UNSURE 69: Xaa = Ile,Asn,Ser
MVPLVAVVSGPRAQLFACLLRLGTQQVGPLQLHTGASHAARNHYEVLVLGGGSGGITMAARMKRKVGAENVAIVEPSERHFYQPIWTLVGAGAXNCPHLVVPR

SEQ ID NO: 3446 - protein, 25 aa, Homo Sapiens
  Substantia nigra
  SIGNAL -20..-1: Von Heijne matrix; score 5.40; seq AFVIACVLSLIST/IY
MDNRFATAFVIACVLSLISTIYMAR

SEQ ID NO: 3447 - protein, 120 aa, Homo Sapiens
  Substantia nigra
  SIGNAL -42..-1: Von Heijne matrix
  score 5.40
  seq WTLLLTSLDGHLL/EP
  UNSURE 68: Xaa = Ala,Val
MPEYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLXQRTFRTFDFY

SEQ ID NO: 3448 - protein, 32 aa, Homo Sapiens
  Surrenals
  SIGNAL -15..-1: Von Heijne matrix; score 5.40; seq RVLCAPAAGAVRA/LR
MNRVLCAPAAGAVRALRLIGWASRSLHPLPGK

SEQ ID NO: 3449 - protein, 45 aa, Homo Sapiens
  Substantia nigra
  SIGNAL -23..-1: Von Heijne matrix; score 5.30; seq MLALLLTAALIFF/AI
MAFTFAAFCYMLALLLTAALIFFAIWHIIAFDELKTDYKNPIDQL

SEQ ID NO: 3450 - protein, 27 aa, Homo Sapiens
  brain
  SIGNAL -17..-1: Von Heijne matrix
  score 5.30
  seq XEXLLAFHHDCEA/SP
  UNSURE -15: Xaa = Asp,Gly,Asn,Ser
  UNSURE -16: Xaa = Gln,Arg
  UNSURE -14: Xaa = Glu,Lys,Met,Val
  UNSURE -11: Xaa = Phe,Leu
  UNSURE -13: Xaa = Ser,Thr
MXXXXEXLLAFHHDCEASPATWNLSPR

SEQ ID NO: 3451 - protein, 76 aa, Homo Sapiens
  brain
  SIGNAL -36..-1: Von Heijne matrix; score 5.20; seq PLRLLNLLILIEG/SV
MGPYNVAVPSDVSHARFYFLFHRPLRLLNLLILIEGSVVFYQLYSLLRSEKWNHTLSMALILFCNYYVLFKLLRDQ

SEQ ID NO: 3452 - protein, 47 aa, Homo Sapiens
  brain
  SIGNAL -23..-1: Von Heijne matrix
  score 5.20
  seq IGVGLYLLASAAA/FY
  UNSURE 23: Xaa = His,Leu,Pro
MMNFRQRMGWIGVGLYLLASAAAFYYVFEISETYNRLALEHIQQHXG

SEQ ID NO: 3453 - protein, 130 aa, Homo Sapiens
  Substantia nigra
  SIGNAL -118..-1: Von Heijne matrix
  score 5.10
  seq AFXVVCWLGPCEA/MH
  UNSURE -11: Xaa = Glu,Lys,Gln
  UNSURE -110,-18: Xaa = His,Gln
MLFASGGFXVKLYDIEQQQIRNALENIRKEMKLLEQAGSLKGSLSVEEQLSLISGCPNIQEAVEGAMHIQECVPEDLELKKKIFAQLDSIIDESSDLKRFXFLSHAFXVVCWLGPCEAMHRGSSCESAIL

SEQ ID NO: 3454 - protein, 34 aa, Homo Sapiens
  Substantia nigra
  SIGNAL -22..-1: Von Heijne matrix; score 5.10; seq LCSLPLSPSAVCP/AP
MQCFLGGLGLCSLPLSPSAVCPAPTSAPWWEGAL

SEQ ID NO: 3455 - protein, 63 aa, Homo Sapiens
  Substantia nigra
  SIGNAL -13..-1: Von Heijne matrix
  score 4.90
  seq MSSFLLSFSQSLS/NV
  UNSURE 36: Xaa = Ala,Gly
  UNSURE 8: Xaa = Leu,Trp
MSSFLLSFSQSLSNVPSALQXPQITFFQHPLSSVMPVWTCSVVPCDKTXQYSYCFYCVLGTVK

SEQ ID NO: 3456 - protein, 76 aa, Homo Sapiens
  Substantia nigra
  SIGNAL -13..-1: Von Heijne matrix
  score 4.90
  seq MLTASLAFQLVDG/VS
  UNSURE 55: Xaa = Ala,Gly
MLTASLAFQLVDGVSWNFSVSKMLASPSTSGQLSQFGASLYGQQSALGLPMRGMSNNTPQLNRSLSQXLSYRATSR

SEQ ID NO: 3457 - protein, 27 aa, Homo Sapiens
  Substantia nigra
  SIGNAL -25..-1: Von Heijne matrix
  score 4.90
  seq LSAFNFLVCLSLG/RG
  UNSURE -23: Xaa =  * ,Tyr
MYXRRELSILCILSAFNFLVCLSLGRG

SEQ ID NO: 3458 - protein, 29 aa, Homo Sapiens
  Substantia nigra
  SIGNAL -22..-1: Von Heijne matrix
  score 4.80
  seq IVFGVSWVMLVYS/AS
  UNSURE 7: Xaa = Asp,Glu,Gly
MGLSAMDTSIVFGVSWVMLVYSASFRRCX

SEQ ID NO: 3459 - protein, 69 aa, Homo Sapiens [sequence omitted]

SEQ ID NO: 3460 - protein, 54 aa, Homo Sapiens
  Substantia nigra
  SIGNAL -26..-1: Von Heijne matrix
  score 4.70
  seq LLICXLXIGTATP/VR
  UNSURE -7: Xaa =  * ,Trp
  UNSURE -19: Xaa = Ala,Thr
  UNSURE -9: Xaa = Asp,Gly
  UNSURE 3: Xaa = Glu,Gly
  UNSURE -16: Xaa = Glu,Val
  UNSURE -17,13: Xaa = Ile,Val
MHWGKRWXLXXGGLLICXLXIGTATPVRXPNGRQVLVPXGYPRPGLGAVGCGEA

SEQ ID NO: 3461 - protein, 36 aa, Homo Sapiens
  Substantia nigra
  SIGNAL -29..-1: Von Heijne matrix
  score 4.60
  seq ALGLXTCLSVLFG/YA
  UNSURE -15,-9: Xaa = Leu,Met
  UNSURE -27: Xaa = Pro,Thr
MAXRYNRLTVLAGAXLALGLXTCLSVLFGYAPQSSP

SEQ ID NO: 3462 - protein, 35 aa, Homo Sapiens
  Substantia nigra
  SIGNAL -29..-1: Von Heijne matrix; score 4.50; seq FMTCILCRPPISS/CV
MGFTGFFTATCFISKVFMTCILCRPPISSCVLECG

SEQ ID NO: 3463 - protein, 42 aa, Homo Sapiens
  brain
  SIGNAL -35..-1: Von Heijne matrix; score 4.40; seq LIVLLPVLFFSLK/NF
MIMYLFVICVIFEIIRNYAFSILIVLLPVLFFSLKNFILSTQ

SEQ ID NO: 3464 - protein, 58 aa, Homo Sapiens
  Substantia nigra
  SIGNAL -37..-1: Von Heijne matrix
  score 4.30
  seq LWEKLTLLSPGIA/VT
  UNSURE 12: Xaa =  * ,Tyr
  UNSURE -27: Xaa = Arg,Thr
  UNSURE -31: Xaa = Phe,Leu
MSTVGLXHFPXPLTRICPAPWGLRLWEKLTLLSPGIAVTPVQMAGKKDXPALLSLDEN

SEQ ID NO: 3465 - protein, 79 aa, Homo Sapiens
  Substantia nigra
  SIGNAL -13..-1: Von Heijne matrix
  score 4.30
  seq MLALAXHLSTVES/EK
  UNSURE -8: Xaa = Arg,Ser,Thr
MLALAXHLSTVESEKQKLRAQVRRLCQENQWLRDELAGTQQRLQRSEQAVAQLEEEKKHLEFLGQLRQYDEDGHTSEAG

SEQ ID NO: 3466 - protein, 53 aa, Homo Sapiens
  brain
  SIGNAL -34..-1: Von Heijne matrix
  score 4.30
  seq QLFAFLNLLPVEA/DI
  UNSURE -24: Xaa =  * ,Ser
MLLSIGMLMLXATQVYTILTVQLFAFLNLLPVEADILAYNFENASQTFDDLPA

SEQ ID NO: 3467 - protein, 76 aa, Homo Sapiens
  brain
  SIGNAL -37..-1: Von Heijne matrix
  score 4.30
  seq LWEKLTLLSPGIA/VT
  UNSURE 21: Xaa = Asp,His,Asn
MSTVGLFHFPTPLTRICPAPWGLRLWEKLTLLSPGIAVTPVQMAGKKDYPALLSLDEXELEEQFVKGHGPGGQATR

SEQ ID NO: 3468 - protein, 165 aa, Homo Sapiens
  Substantia nigra
  SIGNAL -33..-1: Von Heijne matrix; score 4.20; seq LLNFLGLWSWICK/KW
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLR

SEQ ID NO: 3469 - protein, 49 aa, Homo Sapiens [sequence omitted]

SEQ ID NO: 3470 - protein, 43 aa, Homo Sapiens [sequence omitted]

SEQ ID NO: 3471 - protein, 26 aa, Homo Sapiens
  brain
  SIGNAL -20..-1: Von Heijne matrix
  score 3.70
  seq LTIILLPVHLLIT/IY
  UNSURE -16: Xaa = Leu,Gln
MKLKXNVLTIILLPVHLLITIYSALI

SEQ ID NO: 3472 - protein, 56 aa, Homo Sapiens
  Substantia nigra
  SIGNAL -14..-1: Von Heijne matrix
  score 3.70
  seq AALVTVLFTGVRR/LH
  UNSURE 6: Xaa = Ala,Pro
  UNSURE 14: Xaa = Asp,Gly
MAALVTVLFTGVRRLHCSAXLGRAASGXYSRNWLPTPPATGPLPSSQTGHMRMAAR

SEQ ID NO: 3473 - protein, 77 aa, Homo Sapiens
  Surrenals
  SIGNAL -42..-1: Von Heijne matrix
  score 3.70
  seq ILMRDFSPSGIFG/AF
  UNSURE 7: Xaa =  * ,Tyr
  UNSURE 25: Xaa = Asn,Thr
  UNSURE 17: Xaa = Glu,Lys
  UNSURE 12: Xaa = Glu,Lys,Gln
MASVGECPAPVPVKDKKLLEVKLGELPSWILMRDFSPSGIFGAFQRGYXRYYNXYINVXKGSISGIXMVLACYVLFS

SEQ ID NO: 3474 - protein, 25 aa, Homo Sapiens
  Surrenals
  SIGNAL -15..-1: Von Heijne matrix; score 10.90; seq ALLVLVTVALASA/HH
MLALLVLVTVALASAHHGGEHFEGA

SEQ ID NO: 3475 - protein, 56 aa, Homo Sapiens
  Substantia nigra
  SIGNAL -21..-1: Von Heijne matrix; score 8.90; seq VLLFSGFWGLAMG/AF
MRIISRQIVLLFSGFWGLAMGAFPSSVQIGGLFIRNTDQEYTAFRLAIFLHNTSPG

We claim:

1. A purified and isolated nucleic acid sequence encoding a polypeptide comprising amino acids −26 to −1 of SEQ ID NO: 2259 fused in frame to the 5' end of a polynucleotide sequence encoding a heterologous polypeptide.

2. The purified and isolated nucleic acid sequence of claim 1, wherein said nucleic acid sequence comprises nucleotides 170 to 247 of SEQ ID NO: 540.

3. A method of making a cDNA encoding a human secreted protein wherein said method comprises die steps of:
    a) contacting a collection of mRNA molecules from human cells with a primer comprising at least 15 consecutive nucleotides of a sequence complementary to a sequence of SEQ ID NO: 540;
    b) hybridizing said primer to an mRNA in said collection;
    c) reverse transcribing said hybridized primer to make a first cDNA strand from said mRNA;
    d) making a second cDNA strand complementary to said first cDNA strand; and
    e) isolating the resulting cDNA encoding said polypeptide comprising said first cDNA strand and said second cDNA strand.

4. A method of making a cDNA encoding a human secreted protein comprising the steps of:
    a) obtaining a cDNA comprising a sequence of SEQ ID NO: 540;
    b) contacting said cDNA with a detectable probe comprising at least 15 consecutive nucleotides of said sequence of SEQ ID NO: 540 or a sequence complementary thereto under conditions which permit said probe to hybridize to said cDNA;
    c) identifying a cDNA which hybridizes to said detectable probe; and
    d) isolating said cDNA which hybridizes to said probe.

5. A method of making a cDNA encoding a human secreted protein comprising the steps of:
    a) contacting a collection of mRNA molecules from human cells with a first primer capable of hybridizing to the polyA tail of said mRNA;
    b) hybridizing said first primer to said polyA tail;
    c) reverse transcribing said mRNA to make a first cDNA strand;
    d) making a second cDNA strand complementary to said first cDNA strand using at least one punier comprising at least 15 nucleotides of a sequence SEQ ID NO:540; and
    e) isolating the resulting cDNA comprising said first cDNA strand and said second cDNA strand.

6. A method of making a polypeptide comprising the steps of:
    a) introducing into a host cell or organism a nucleic acid sequence encoding a polypeptide comprising amino acids −26 to −1 of SEQ ID NO: 2259 fused in frame to the 5' end of a polynucleotide sequence encoding a heterologous polypeptide
    b) providing conditions that allow for the expression and secretion of said polypeptide by said host cell, organism, or tissue.

7. The method of claim 6, wherein said nucleic acid is operably linked to a promoter.

8. The method of claim 6, further comprising the recovery of said expressed and secreted polypeptide.

9. The method of claim 8, wherein the step of isolating the expressed and secreted protein comprises purifying the secreted protein from the supernatant, the culture medium or the cell extract of said host cell, organism, or tissue.

10. The method of claim 6, wherein said nucleic acid encodes a polypeptide comprising amino acids −26 to −1 of SEQ ID NO: 2259.

11. A vector comprising a nucleic acid encoding a polypeptide comprising amino acids −26 to −1 of SEQ ID NO: 2259 fused in frame to the 5' end of a polynucleotide sequence encoding a heterologous polypeptide.

12. A purified and isolated nucleic acid sequence encoding a polypeptide comprising:
    a) amino acids −1 to 29 of SEQ ID NO: 2259; or
    b) amino acids −26 to 29 of SEQ ID NO: 2259.

13. The purified and isolated nucleic acid sequence of claim 12, wherein said nucleic acid sequence encodes amino acids 1 to 29 of SEQ ID NO: 2259.

14. The purified and isolated nucleic acid sequence of claim 12, wherein said nucleic acid sequence encodes amino acids −26 to 29 of SEQ ID NO: 2259.

15. The purified and isolated nucleic acid sequence of claim 14, wherein said nucleic acid sequence comprises nucleotides 170 to 334 of SEQ ID NO: 540.

16. A vector comprising a nucleic acid sequence encoding a polypeptide comprising:
    a) amino acids 1 to 29 of SEQ ID NO: 2259; or
    b) amino acids −26 to 29 of SEQ ID NO: 2259.

17. The vector of claim 16, wherein said nucleic acid sequence encodes amino acids 1 to 29 of SEQ ID NO: 2259.

18. The vector of claim 16, wherein said nucleic acid sequence encodes amino acids −26 to 29 of SEQ ID NO: 2259.

19. The vector of claim 16, wherein said nucleic acid sequence comprises nucleotides 170 to 334 of SEQ ID NO: 540.

20. A method of making a polypeptide comprising:
    a) introducing into a host cell or organism a nucleic acid sequence encoding a polypeptide comprising:
        i) amino acids 1 to 29 of SEQ ID NO: 2259; or
        ii) amino acids −26 to 29 of SEQ ID NO: 2259; and b) providing conditions tat allow for the expression and secretion of said polypeptide by said host cell, organism, or tissue.

21. The method of claim 20, wherein said nucleic acid is operably linked to a promoter.

22. The method of claim 20, wherein said nucleic acid encodes amino acids 1 to 29 of SEQ ID NO: 2259.

23. The method of claim 22, wherein said nucleic acid sequence is operably linked to a promoter.

24. The method of claim 20, wherein said nucleic acid encodes amino acids −26 to 29 of SEQ ED NO: 2259.

25. The method of claim 24, wherein said nucleic acid sequence is operably linked to a promoter.

26. The method of claim 25, wherein the step of isolating the expressed and secreted protein comprises purifying the secreted protein from the supernatant, the culture medium or the cell extract of said host cell, organism, or tissue.

27. The method of claim 20, further comprising the recovery of said expressed and secreted polypeptide.

* * * * *

UNITED STATES PATENT AND TRADEMARK OFFICE
CERTIFICATE OF CORRECTION

| | |
|---|---|
| PATENT NO. | : 7,393,663 B2 |
| APPLICATION NO. | : 10/631441 |
| DATED | : July 1, 2008 |
| INVENTOR(S) | : Jean-Baptiste Dumas Milne Edwards, Aymeric Duclert and Bruno Lacroix |

It is certified that error appears in the above-identified patent and that said Letters Patent is hereby corrected as shown below:

Column 2,
Line 62, "operably lining" should read --operably linking--.

Column 5,
Line 6, "Further, polyeptides" should read --Further, polypeptides--.

Column 6,
Line 5, "5-carboxymethylarninomethyluracil" should read
--5-carboxymethylaminomethyluracil--.

Column 8,
Line 11, "determing" should read --determining--.
Line 25, "flumes" should read --frames--.

Column 10,
Line 11, "next tote" should read --next to the--.

Column 12,
Line 37, "oat least" should read --of at least--.

Column 16,
Line 26, "minimnum" should read --minimum--.

Column 19,
Line 12, "indentical" should read --identical--.

Column 26,
Line 3, "fingal" should read --fungal--.
Line 50, "BlueScrit" should read --BlueScript--.

Column 27,
Line 11, "geneII" should read --geneII--.

Column 29,
Line 46, "fingal" should read --fungal--.

UNITED STATES PATENT AND TRADEMARK OFFICE
CERTIFICATE OF CORRECTION

| | | |
|---|---|---|
| PATENT NO. | : 7,393,663 B2 | |
| APPLICATION NO. | : 10/631441 | |
| DATED | : July 1, 2008 | |
| INVENTOR(S) | : Jean-Baptiste Dumas Milne Edwards, Aymeric Duclert and Bruno Lacroix | |

It is certified that error appears in the above-identified patent and that said Letters Patent is hereby corrected as shown below:

Column 33,
Line 53, "amibiguities" should read --ambiguities--.
Line 60, "amibiguity" should read --ambiguity--.
Line 63, "amibiguity" should read --ambiguity--.

Column 36,
Line 10, "Proc. Nail. Aca. Sctl." should read --Proc. Natl. Acad. Sci.--.

Column 37,
Line 38, "liner" should read --inner--.
Line 48, "using Die Terminator" should read --using a Die Terminator--.
Line 59, "EcoRi" should read --EcoRI--.

Column 38,
Line 15, "primer walling" should read --primer walking--.
Line 30, "polyadenyaltion" should read --polyadenylation--.

Column 45,
Line 16, "intitiation site, an intiating" should read --initiation site, an initiating--.
Line 29, "polpypeptide" should read --polypeptide--.

Column 49,
Line 22, "Herrrann et al." should read --Herrmann et al.--.

Column 51,
Line 37, "allergenic cardiac" should read --allogeneic cardiac--.

Column 55,
Line 28, "tendinitis" should read --tendonitis--.
Lines 59-60, "(endotheliun)" should read --(endothelium)--.

Column 56,
Line 2, "cytokinc" should read --cytokine--.
Line 31, "Wiley-Intersciece" should read --Wiley Interscience--.
Line 42, "activities. inhibins are" should read --activities. Inhibins are--.
Line 47, "the Inhibin α" should read --the inhibin α--.

UNITED STATES PATENT AND TRADEMARK OFFICE
CERTIFICATE OF CORRECTION

| | | |
|---|---|---|
| PATENT NO. | : 7,393,663 B2 | Page 3 of 5 |
| APPLICATION NO. | : 10/631441 | |
| DATED | : July 1, 2008 | |
| INVENTOR(S) | : Jean-Baptiste Dumas Milne Edwards, Aymeric Duclert and Bruno Lacroix | |

It is certified that error appears in the above-identified patent and that said Letters Patent is hereby corrected as shown below:

Column 59,
Line 7, "ischemic-reperfusioninury" should read --ischemia-reperfusion injury--.

Column 61,
Line 60, "81: 39984002" should read --81: 3998-4002--.

Column 74,
Lines 23-24, "by adding antiserum-producing" should read --by adding fluorescein- or enzyme-conjugated antibody against the immunoglobulin class of the antiserum-producing--.

Column 78,
Line 15, "Ranaiah Nagaraja" should read --Ramaiah Nagaraja--.

Column 80,
Line 21, "vector and filsed" should read --vector and fused--.

Column 82,
Line 31, "antiserurn-producing" should read --antiserum-producing--.

Column 87,
Line 28, "5' postion" should read --5' position--.
Line 33, "bding the coding" should read --binding the coding--.

Column 88,
Line 48, "avalilabe from" should read --available from--.

Column 89,
Line 23, "ribozyrne capable" should read --ribozyme capable--.

Column 94,
Line 63, "are as defmed" should read --are as defined--.

Column 95,
Line 23, "of the polypeptides the polypeptides of" should read --of the polypeptides of--.

UNITED STATES PATENT AND TRADEMARK OFFICE
CERTIFICATE OF CORRECTION

| | | |
|---|---|---|
| PATENT NO. | : 7,393,663 B2 | |
| APPLICATION NO. | : 10/631441 | |
| DATED | : July 1, 2008 | |
| INVENTOR(S) | : Jean-Baptiste Dumas Milne Edwards, Aymeric Duclert and Bruno Lacroix | |

It is certified that error appears in the above-identified patent and that said Letters Patent is hereby corrected as shown below:

Column 96,
Lines 45-46, "may be determiined" should read --may be determined--.

Column 106,
Line 6, "detennine" should read --determine--.

Column 224,
Table III, SEQ ID NO. ID621, "MTSGQAPASXQSPQALEDSGPVNISVSITLT LDPLKPFGGYSRNVTHLYSTILGHQIGLSGREAHEEINITFTLPTAWSSDD CALHGHCEQVVFTACMTLTASPGVFP" should read --MTSGQARASXQSPQALEDSGPVNISVSITLTLDPLKPFGGYSRNVTH LYSTILGHQIGLSGREAHEEINITFTLPTAWSSDDCALHGHCEQVVFTA CMTLTASPGVFP--.

Column 254,
Table III, SEQ ID NO. ID951, "MGEASPPAPARRELLVLLLLLSTLVIPSAA" should read --MGEASPPAPARRHLLVLLLLLSTLVIPSAA--.

Column 277,
Table III, SEQ ID NO. ID1201, "MKKTGDGGTLSTERIGGAALLSLLLK RNKMTLMIPLLLLTPITA" should read --MKKTGDGGTLSTERIGGAALLSLLLKRMKMTLMIPLLLLTPITA--.

Column 279,
Table III, SEQ ID NO. ID1225, "MCNPEEAALXGLEEVFSATLAMVNSLV LQPLLPAAPDPSDPWGRECLRLLQQLHKSSQQLWEVTEESLHSLQERLR YPDSTGLESLLLLRGADRVLQA" should read --MCNPEEAALXGLEEVFS ATLAHVNSLVLQPLLPAAPDPSDPWGRECLRLLQQLHKSSQQLWEVTE ESLHSLQERLRYPDSTGLESLLLLRGADRVLQA--.

Column 282,
Table III, SEQ ID NO. ID1256, "MEPITFTARKHLLPNEVSVDFGLQLVGSLPVH SLTTMPMLPWWAEVRRLSRQSTRKEPVTXQXRLCVSPSGLRC" should read --MEPITFTARKHLLPNEVSVDFGLQLVGSLPVHSLTTMPM LPWVVAEVRRLSRQSTRKEPVTXQXRLCVSPSGLRC--.

UNITED STATES PATENT AND TRADEMARK OFFICE
CERTIFICATE OF CORRECTION

PATENT NO. : 7,393,663 B2
APPLICATION NO. : 10/631441
DATED : July 1, 2008
INVENTOR(S) : Jean-Baptiste Dumas Milne Edwards, Aymeric Duclert and Bruno Lacroix It is certified that error appears in the above-identified patent and that said Letters Patent is hereby corrected as shown below:

Column 293,
Table III, SEQ ID NO. ID1375, "MTVELWLRLRGKGLANLHVTRGVXG"
    should read --MTVELWLRLRGKGLAMLHVTRGVXG--.

Column 329,
Line 24, "die steps of" should read --the steps of--.
Line 59, "punier comprising" should read --primer comprising--.

Column 330,
Line 38, "-1 to 29" should read --1 to 29--.

Column 331,
Line 1, "tat allow" should read --that allow--.

Signed and Sealed this

Thirtieth Day of December, 2008

JON W. DUDAS
*Director of the United States Patent and Trademark Office*